United States Patent 7,968,689 (ANTIBODIES TO HSDEK49 POLYPEPTIDES) - sequence listing, part 2

SEQ ID NO: 1864 - DNA, 3872 bp, Homo sapiens
gaggcaggaccttgtcctattcattaatcttgcccctcaacagttattttcagaggggcaagaagtgtttcagggttcttggcccttgtttgaccagtcgtcctaaccctcatgtcttgggtcattgttgttataatctggggttaccttttggaaggtcatggggtacccttttgcaaaagttatgggccctctccttggaaactgcacacacaccatgcagcttacaattcagggagttcacaggtctacagaatcctggaaactctcatgtccggttctactcattgtagcttcagtggaaccttctagcagtcctttccagctcctccccagctcctcagctctgcttccctccgcccatcaagccctcctcagcccataaggtgggccaggtggcctgtggggataaatcagagtgcccacaagtgcaggggcccaaagacatcccagagcaaacccaagaatccctctacaagccccagcccactcagaaggatgcattttgccccctctgtttatttgtttgtttttaattatgaaagtagggcatggtcattgttgagaatgtgagaaatgcagagaagttaaaatgatgctttttgtttagggcgctgctgcttctggcttaagatcctaaatcaaagcagctgccagatctggacctaagacttgcttcccatcaccttacataaaagaaagagcactggactaggaatcaaagatctgaattcccatcaaatctctgctattactagcttttatctctatttatttatttatctgtctatctatctagtaccttttgtgaatatgagtgtttctcaccgaggccctcccatctctcttgcccccgatcctggaatggaccaaataccttgtttactgaaggatacagatggcatgtgactgttgagaatcactcaccctcttagagccatggtttcctcttctataaaatagggatgttcgtgcctatttgctaatcatgagtgacaatgacataaggtacataaagctgtactgcatgatgcaaacataacatcatatttgtagggttgttgctaataatactatccatcagcaaagcagtcattcatttactcagtcaaatactgatgcactggtacattcagtttcctcttttgtaaaatggggataaaaataggacttagctcatagggtatttaagattcagtgagttaatatatataaaatacttagagcagtccttggaacatattaagaactcaatacatattagctagttgagcaggctgtagtatttgttccagccaagaaaagactgttctctaacagcacaggaaataaagatggggttaggcacgacacggcagcaggacttaccttctgtctaattcagctggcagtcaaagaaagaattattagaagcctatgagcttgttctcccaaagatctactgagtacagggggatatttaaagaataaaaatccctagacccacttacagtacaggagagacaagaagctgttcacacaataacaagtgctaaattccttgatttttatactgacagctgaagttttagagaagagaaggatcaataaagaccggaatattaaagcagacaggcctaaaagaggattttagatttgataaagaattcctccagttctcagagcagggactttggagggtaacaacttggatttcagtccttgcctgccacttactgattgtatgaccttggaaaagttacttcacttctgtgagcaatgattctctcatctggaaaacaaaacaaaacaaaaaaactaacaagggtgataataatacctacctccctacctcatagggctgatgagaagattaaaaagtacctacataaagcccttctctgcgtgcctggagcatggcaagggctccatgtgaaccactatttttttttttttttttaatgaaaagtcatgggcagcaccaaagctcagaattttggcagtaaggaattatgattctacattgaaatttgccagaaggggagctgactgcctcatgagacatttttgaatgaggccaaaaaaggaaacaagtgtatcctgggattttacgagatgctaggtatgtccttagcacttaatcctcatgactaccctatgatgtaagtactatctgttgtccctattttacagttggccaaggtcacatagctgaaacggacttctgtgtgtcttctaacttttgctttcaggtctggaaaaatgcaatgtaaacctagaccctctttgaaatactgaagatggtaatcttatcccttcctcactttctgttttctaaaataacagtccttgttccttacaatgtctgttttccagattcttagaagactttttgcttattttccataactctttacttgtgatccctgaatgacaccgggggtatagcagagaatgtccatttcctcaaagttcaaaggtcctacaaaaaatagttgctagcctggcatgatggtgtgtgcctgtagcctcagctacctgggaggctgaggcaagaggattgcttgagctgaggagtttgaggctgcagcgagccatgatcacgccactgctctccagcctggatgacaaagcaagatcacatcttaaaataaaataaaataaattttaaaaatatataaaaaataaaaagtggtgccactaagtgtcctggacagcattagagaaagcaagagatagaagagtgcaaacacctgaaaggaaagagatgcgggtcttccctctcccttgagtagccaccggctatccctggagcataggagtaggattttatcccccagcttcggcctccccaggcagcacttcctttctgtgctttgactccaatttggatggtgctcaggcgggaagtaggctggggtgggaggagtttaggggaatatttgtcttctctcctgttttgccctagagattctggccaggaagacaaatggctagtaccacttggtccttttcttttcttcttttgagacagggtcttgttctgttgcccaggctggagtgcagtggcgtgatcgcggctcaccgcagcctcccaggctcaagcattcctctcacctcagcctcctgagtagctgggaccacagctccactaattttgaagtttttttggtagacatgaagtctccctgtgttgcccgggctggtctcaaactcctgacctcaagcagtcctcctgtcttggcctctggaaatgctgggattacaggcgtgagccactgtgctggcctcttttttctttttctttttttttaaggtttttatttgttaaatgggaagtctgtgccatcaactgagcattgtattttctccttagtaagagcctgggtgggccactgggagagaactatacattaaatgtaagtagcctctgggtagagagcccctggctggtttcctttcctttctctccttttctctactttggtgtctggaggcatttcccagactccagtttcttaccaccctcacggattttgctattgtattatcacctcctttatcattcccaaaattgactttatggagactcattaaaagaaaaaatcatcggccgggagcggtggctcacgccacgaaggcgggcgaatcacctgaggtgcggagttcgtgaccagcctgaccaaaacagagaaaccccatctctactaaacaatacaaaattagctgggcgtggtggtgcacgcctgtaatcccagctactggggaggctgagacaagagaatcacttgaacccgggaggcagaggttgcagtgaccaaagatcgcactattgcactccagcctgggcaacaagagcaaaactctatctcaaaaaaaaaaaaaaaaaaaag

SEQ ID NO: 1865 - DNA, 280 bp, Homo sapiens
tcacgcctgtaatcctagcactttgggaggcggaggcaggcggatcacctgaggtcgggagttcgagaccagcctgaccaacatggagaaaccccgtctctactaacaatacaaaaaaattagccgagcatggtggcgcatgcctataatctcagctacttgggaggctgaggcaggagaatcgcttgaacctgggaggcggaggttgcagtgagccgagatcgcgccattgcactccagcctgggcaacaaaagcgaaactcggtctcaaaaaaaaaaa

SEQ ID NO: 1866 - DNA, 8680 bp, Homo sapiens
cctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccacccccacctccggtctgctcctgagacctggctctggctgtaaggccctcctcccctcctctcccgtcctcatcccttccctcctctccccttccttccagtgcagtgccagctcctcagggactgttctgacactgcttccaggaagccttccttgcaccccagtgctggatgctgggtcaagggcctttctccaatagtaccctgtgccctgtcacagtcctttattgctgcatggacctttcgttatttaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggcctggggaggggtaagaatggagccccaagaaccattctgcccattgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggtgggttgggctgggagcaggggtcctactggggtgctgagtgaaatggagcaggtgctggggggcctgggagaaggtgggtggaggcccctggcttgcctgatgcaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtgagcacctctcctggggccctgcctggaatcgctggggtcctgggcccctcccagaccccctgggctactgagtgatgccccaccctgctgggtctaggtacccctggggacaggaagccttcgacaaggccaggaaggaaaacaagccgattttcctctcaggtaatgctcccaccttccctgatgtgggggtgtgggcagggagtggcagtggatgggggagggtcctctcggcctggcgggtcttccaggagactagaggccaggacgtcttccatgtagccagggccacttggccagcctccctctgacccgttgctggccccctgacctctccccatggccctgttcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggtgagcagccctcctcgggagtgtatgcgccacatgggctcagagcagctcccctcaccctcgccctctctccgccaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacaggtgggtgtgcctccgggagttgggggaccagggtgggggactaggaaacaagagcccctccccctagctgacctccaggtgtgcccccacctcccgcagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccgggtcagtgccccacgcccgccttagcccaggctttggccttctgattcctatgctggtcagggacctactggctcctggcctcacccatagcttcctgtcctcctgactggcagtgacctccttgcccctagcctgtcggtagctatcggtgaagacccgactgctggtgtcagcagtgaccctctcaccttaacctagatgatgaccttctgtcccctgacttggtcagttacccagtgaccctgacttggctaatgacattctgggctctagggggacaagtaacttactggtcctctgtgaaccaatgatattctgacctctggcttaggctattaccttctgtcctgtgggttgactcttgacctcacagcctgtccagagactgcctgttgagtgaactcccagcctctgcctggcccaaggcctcctgaccaccccgatctctgtccccactttcccattctctcacctgcatgttcttggtgcccccacagtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccaggtgacccctgaccccagcccagagaacaggcatctcactctggctgcccctcccaaggccttcctggtgactgtggcttctcttaatctgaatcccctgttccctcccatgtacccactacccaggcttccctcccccgcctgcctcagagaatgttgccaccttccacctgggcctccccagtgacctctctgttcacagtctcctttcttccctttcttagctctctggtgatgaattctactctgacgtggccaaaggcatcctgcagtacgtggctcggagcctgagccaccgggtgtgtgtccatggtggcaggcaggcctggctgtgggaggggttggggcctccactgccctgtgggccggggccagccaactctcccctccccacagtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggtgaggacttctggggtcacctgacgggccctggtgcctgccaggcgtgtgagctcgcagacaaaggccattctcctcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacggtcagtgggggtgcagggctagtctggggtcctgggaggtgtaagtgcagcgtgggtgaagagctggtgtgggcaggagccctcctggctttgtgtctctgctacttattaatggcgtgatttttggctgctgtaatatttctgtgtctcaatttcttttttttaaatagagacagagtcttgctatgttgcccaggctgatcttgaaatcctgggctcaagtgatcctcccacctcggcctcccaaagtgctgggattacaggcatgaaccactacactcagcgtgttttgtttcgttcctttcttttctttttatttcctttctctttctttctttctctttcctttcttcctttctttcttttctttctctctttctttctcttttttttttttttttgagacagggtctcactgtcacccaggctggaatgcagtggcatgatcttggctcacagcaacctctgcctccggggctgaatcaattctcccacctcagcctcctgagtagctaggactataggcatgcaccaccatgcctggctaattttttgtagagatgggatttctccatgttgcccaggctggtctgaaactactgggctcaagtgatctgcccacctcggcctcccaaagtgctgggattacaggcgagagccaccatgcctggcctgtttcttaataagtaaaatggagctaacattggtactaccttacagggttgatgtaaagatgaatgtagctgttctgtaaacatgcttagcacagtaactgacacccatggattcagatattgaccaaggctcacttggtctctgccctcatgaagcttacagtatggtaggggagacagcgaaaatgcagtaatgatgcaaaaacacatgcacaaatgtgcagttaaaattgtggtgagtgccatgaagaagtaggacgctctatgtgtgcctgctccctatcacccatgtgccttgtctgtggttaaaggtttctttcccaaaactcaaattttagctcctcaaagatcaggactttctgccactgttgtatccccagggtctagtgtggttctggcacattgtaagtgcttaataaatgttaactgagtgaatgaaagggccttgggagagaaccacagaggaggaccaactcagcctagggagagattagaggacacctgtgacaggtgtcatttaaccaaggcctggagggaaagaggggccatgtggccatggagaagctgtggagagagttcaggcatagggagcagtgcatgacaggcctggtgcaggcagcctgtatcctggaggacaggcagggcccgcgtgttccaggagggcaccgaggagaatgctgaggccggcagggcacggaagccgtcttttttttttttttttcctaagaaaagaaggctggtctcaaactcctgggctcaggtgatcctcccgcctcggcttcccaggtgctgggactacaggtgtgagccaccatgcccggctggcaaggaggttttaagtggattgtgatctgctctggtatggttttaaggaggtcactctgaccactgatggagagaagtgggggtgggggaaacaggcgaccagttaggaggccattactcgtgttcagtccaggcaggcattggtgaaggctcagaggatgtggaagtatgagatggggagacatggtgagatttggatctcttctggccacagccctggcaagactcacagatggattagaagcggagggagagggagaggaaggggacaggatgatgccgctctagcttgagcagctgagtggctggacagaggcatcagcagcgaggagggagcctggagaccaacagttgaggctaggacaggtagagtggagggtgccataaaaaagacagcaaagtactgataactgctggagtggcatccacacccagagcggggaaggggcaggatgggcagggccttttctctgtcccgtcccccaagtggccctggatacagtcctgggcagggtcctgggactcagtgacctgcccttacccccaccccctgcctccctatgtgctgtagaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcaggtggggggtgagggcatctgggctgggacctcgggtaggagggaagttggggctgcgatggcagatgggaacagggggtggggttcctgggctgtccccagagctcaggtctgtgtgtgtgcaggcacgtggcctgtcagacagggaggcagaagttaatatgagtccgtggtggctgatgaagtgtttctctgtacgtcttggtgtcagtgtaattgcttctgtccatactgtgttactggtgtgtgtgtacttccgggtgtgtgtgaccctggaggtgtgtgtctgtgcacctacctttgagggggatgctggtgtgagtgtttgtctgtctgcatgtggatgccccatctgcaggtttgcctctgtgtctgcctgcatgcgtgtgtgtctggtgtttgtgtgtgtggtatctgcctctgtgtgggcatctactgtgtgtgtgtgtgtgtgtgtgtgtgtgtgtgtgtgtgtgtgtgtgactactctgtgtctgtctgaatgggtctctgtgtgctctgggtcttctgggtgtgtgtctccccatgtttgtatctgtaccattgtgtatatgtatgacatttccacttcggtattctcatgtgtgagtgtgtgtgtgtgttcccacttgccaagcattaactcatcctggcagctgagatgagtccctgttccttcttagagatatacggtggggcggaaggaggatggggaagccctggtggtctagggctcagccctccctcccctgacacaccggagtgacctttctattccggtcagatcgtgatctgtggagaccgtcaggccaaggacaccaaggccctggtgcagtgcgtccactctgtctacattcctaacaaggtacccatccctgtgagcccaatctgccacctccccagagctgccccctcccatcctcagctcctcaacatctccttcccctcagaatgttgggaagagggaacttcccagtgggcctttctaatgggcaggtgaccccaccccggcaggtgactctccctgctctgctgctgccctaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 1867 - DNA, 8677 bp, Homo sapiens
cctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccaccccacctccggtctgctcctgagacctggctctggctgtaaggccctcctcccctcctctcccgtcctcatcccttccctcctctccccttccttccagtgcagtgccagctcctcagggactgttctgacactgcttccaggaagccttccttgcaccccagtgctggatgctgggtcaagggcctttctccaatagtaccctgtgccctgtcacagtcctttattgctgcatggacctttcgttatttaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggcctggggaggggtaagaatggagccccaagaaccattctgcccattgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggtgggttgggctgggagcaggggtcctactggggtgctgagtgaaatggagcaggtgctggggggcctgggagaaggtgggtggaggcccctggcttgcctgatgcaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtgagcacctctcctggggccctgcctggaatcgctggggtcctgggcccctcccagaccccctgggctactgagtgatgccccaccctgctgggtctaggtacccctggggacaggaagccttcgacaaggccaggaaggaaaacaagccgattttcctctcaggtaatgctcccaccttccctgatgtgggggtgtgggcagggagtggcagtggatgggggagggtcctctcggcctggcgggtcttccaggagactagaggccaggacgtcttccatgtagccagggccacttggccagcctccctctgacccgttgctggccccctgacctctccccatggccctgttcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggtgagcagccctcctcgggagtgtatgcgccacatgggctcagagcagctcccctcaccctcgccctctctccgccaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacaggtgggtgtgcctccgggagttgggggaccagggtgggggactaggaaacaagagcccctccccctagctgacctccaggtgtgcccccacctcccgcagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccgggtcagtgccccacgcccgccttagcccaggctttggccttctgattcctatgctggtcagggacctactggctcctggcctcacccatagcttcctgtcctcctgactggcagtgacctccttgcccctagcctgtcggtagctatcggtgaagacccgactgctggtgtcagcagtgaccctctcaccttaacctagatgatgaccttctgtcccctgacttggtcagtgacccagtgaccctgacttggctaatgacattctgggctctagggggacaagtaacttactggtcctctgtgaaccaatgatattctgacctctggcttaggctattaccttctgtcctgtgggttgactcttgacctcacagcctgtccagagactgcctgttgagtgaactcccagcctctgcctggcccaaggcctcctgaccaccccgatctctgtccccactttcccattctctcacctgcatgttcttggtgcccccacagtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccaggtgacccctgaccccagcccagagaacaggcatctcactctggctgcccctcccaaggccttcctggtgactgtggcttctcttaatctgaatcccctgttccctcccatgtacccactacccaggcttccctcccccgcctgcctcagagaatgttgccaccttccacctgggcctccccagtgacctctctgttcacagtctcctttcttccctttcttagctctctggtgatgaattctactctgacgtggccaaaggcatcctgcagtacgtggctcggagcctgagccaccgggtgtgtgtccatggtggcaggcaggcctggctgtgggaggggttggggcctccactgccctgtgggccggggccagccaactctcccctccccacagtccggaggcttctatagcgcagaagatgcagactcgcccccagagcggggccagcggcccaaagagggcgcctactatgtgtggacggtcaaagaggttcagcagctcctgccggagcctgtgttgggtgccaccgagccgctgacctcaggccagctcctcatgaagcactacggcctcacagaggctggtaacatcagccccagtcaggtgaggacttctggggtcacctgacgggccctggtgcctgccaggcgtgtgagctcgcagacaaaggccattctcctcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacggtcagtgggggtgcagggctagtctggggtcctgggaggtgtaagtgcagcgtgggtgaagagctggtgtgggcaggagccctcctggctttgtgtctctgctacttattaatggcgtgatttttggctgctgtaatatttctgtgtctcaatttcttttttttaaatagagacagagtcttgctatgttgcccaggctgatcttgaaatcctgggctcaagtgatcctcccacctcggcctcccaaagtgctgggattacaggcatgaaccactacactcagcgtgttttgtttcgttcctttcttttctttttatttcctttctctttctttctttctctttcctttcttcctttctttcttttctttctctctttctttctcttttttttttttttttgagacagggtctcactgtcacccaggctggaatgcagtggcatgatcttggctcacagcaacctctgcctccggggctgaatcaattctcccacctcagcctcctgagtagctaggactataggcatgcaccaccatgcctggctaattttttgtagagatgggatttctccatgttgcccaggctggtctgaaactactgggctcaagtgatctgcccacctcggcctcccaaagtgctgggattacaggcgagagccaccatgcctggcctgtttcttaataagtaaaatggagctaacattggtactaccttacagggttgatgtaaagatgaatgtagctgttctgtaaacatgcttagcacagtaactgacacccatggattcagatattgaccaaggctcacttggtctctgccctcatgaagcttacagtatggtaggggagacagcgaaaatgcagtaatgatgcaaaaacacatgcacaaatgtgcagttaaaattgtggtgagtgccatgaagaagtaggacgctctatgtgtgcctgctccctatcacccatgtgccttgtctgtggttaaaggtttctttcccaaaactcaaattttagctcctcaaagatcaggactttctgccactgttgtatccccagggtctagtgtggttctggcacattgtaagtgcttaataaatgttaactgagtgaatgaaagggccttgggagagaaccacagaggaggaccaactcagcctagggagagattagaggacacctgtgacaggtgtcatttaaccaaggcctggagggaaagaggggccatgtggccatggagaagctgtggagagagttcaggcatagggagcagtgcatgacaggcctggtgcaggcagcctgtatcctggaggacaggcagggcccgcgtgttccaggagggcaccgaggagaatgctgaggccggcagggcacggaagccgtcttttttttttttttttcctaagaaaagaaggctggtctcaaactcctgggctcaggtgatcctcccgcctcggcttcccaggtgctgggactacaggtgtgagccaccatgcccggctggcaaggaggttttaagtggattgtgatctgctctggtatggttttaaggaggtcactctgaccactgatggagagaagtgggggtgggggaaacaggcgaccagttaggaggccattactcgtgttcagtccaggcaggcattggtgaaggctcagaggatgtggaagtatgagatggggagacatggtgagatttggatctcttctggccacagccctggcaagactcacagatggattagaagcggagggagagggagaggaaggggacaggatgatgccgctctagcttgagcagctgagtggctggacagaggcatcagcagcgaggagggagcctggagaccaacagttgaggctaggacaggtagagtggagggtgccataaaaaagacagcaaagtactgataactgctggagtggcatccacacccagagcggggaaggggcaggatgggcagggccttttctctgtcccgtcccccaagtggccctggatacagtcctgggcagggtcctgggactcagtgacctgcccttacccccaccccctgcctccctatgtgctgtagaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcaggtggggggtgagggcatctgggctgggacctcgggtaggagggaagttggggctgcgatggcagatgggaacagggggtggggttcctgggctgtccccagagctcaggtctgtgtgtgtgcaggcacgtggcctgtcagacagggaggcagaagttaatatgagtccgtggtggctgatgaagtgtttctctgtacgtcttggtgtcagtgtaattgcttctgtccatactgtgttactggtgtgtgtgtacttccgggtgtgtgtgaccctggaggtgtgtgtctgtgcacctacctttgagggggatgctggtgtgagtgtttgtctgtctgcatgtggatgccccatctgcaggtttgcctctgtgtctgcctgcatgcgtgtgtgtctggtgtttgtgtgtgtggtatctgcctctgtgtgggcatctactgtgtgtgtgtgtgtgtgtgtgtgtgtgtgtgtgtgtgtgtgtgactactctgtgtctgtctgaatgggtctctgtgtgctctgggtcttctgggtgtgtgtctccccatgtttgtatctgtaccattgtgtatatgtatgacatttccacttcggtattctcatgtgtgagtgtgtgtgtgtgttcccacttgccaagcattaactcatcctggcagctgagatgagtccctgttccttcttagagatatacggtggggcggaaggaggatggggaagccctggtggtctagggctcagccctccctcccctgacacaccggagtgacctttctattccggtcagatcgtgatctgtggagaccgtcaggccaaggacaccaaggccctggtgcagtgcgtccactctgtctacattcctaacaaggtacccatccctgtgagcccaatctgccacctccccagagctgccccctcccatcctcagctcctcaacatctccttcccctcagaatgttgggaagagggaacttcccagtgggcctttctaatgggcaggtgaccccaccccggcaggtgactctccctgctctgctgctgccctaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 1868 - DNA, 5846 bp, Homo sapiens
gctttatatgagcttttatatttcacagaatggtgactttgcatatgccctggtgcattgtgggagctgctattgtcacgactaagacatttcttttggggtatccatctagccccagcctcgaaaggatggaagcagggcctccttgcaggaggtcatgttgtccatttgtctgctttcatacaagctggtccaaagaaagagttctctttcgtttggaacatctgttgggttggaagtccttccccaaatctatctgagtccttcttgctgcagagaaagccttcctgtgacctcatcctttcccctaaatgttgggaaatgctcctgagtcctgtccttgacacatacatcttccttgggttgagggatggggactgggacacatgctttgggaagggcaggtgcagagtgatggggctgacggggtgggggaagcagggggaggagctgtccctctgaggcctttgggaatcggctgtgccaggcatcctcagccctccagctaagcaacacagagagccaaaagaggctactagagacaagaaggccttcatggggccactgcttgtgggggatgtcagcagtggggaggagtgaagcaggaaggaaccgggagactggatggaattgctcccttcacacggtcacacatagccacacatggtcactgggaccagagtcagctctgtctgggcagccaggccctcagtgcaagccaccagcccatctggaggggattagtgctccggccaacaaggtcagctggccccttcctagctggagcctactcaaccttgccaggaagtcagagagctggacaagtggagcccagcctggggaggtggaagagagggaggatggagcatggtgaagcacaggtggcctttttggcagccccagccctggctttggaacagtctgggcagtgtgccaacccctcttgccactgtcgtcccattgaccctcatgaatgagttgcgaggcagttaccttcagcctcctatggataaatattcgaggcccagagagggtaagagacctgcctgcgacccctcagcacttctgtttctctctggggtcttgagggtacaataaagacccctaaggcttcctcttctcgcaggaggtccaggcgcagctgtgggggagggtgcccttggtgtcttctgtccctgcagccagtctgctttctactcggcagctcctctctccctcctgggatgagatgtgcacgcgatgatgggattctgtaaatgggttgggaagaaggagttacctccttaaagggttagttctcccaggagtgctcgaatttctaaagggggcagggtcccacataaatctcactcagaagcaggattataagagttcctgcagcatcccttcccctttgctggtccctcttgagtgtgcaccctgttctaccagcggaacacctgcgggccagggtcactggagacagggccataccgtctgggcggtcacttaagtaacttcatcattctgagcaccccccttccttatctgaaaggtggggggccatccacccagctctcagggctgttaaggtgactaaatgggataatggttgtatcatccctgagcaaagggtatcacagatgggaagattatcttagctccgcagggagccagatgggctgtgagggaggggtaaaggcagggctggagggggctggaggggctggctgagcagggtatatatggggggggttcttcctcaaacccagaaaaactcttagttaggcttagtgtctttgttgagaaactgaggcccaaagaaaggaatttcttgtccctttgtttccctttccctgcctgaggtcattcattcacctaacaactttgtgcccgacactagacaaggccctagtgagcaaaatgaacatagcccctctgggaacacagagcctagatagggagatgatcatttcattactgcaaacacaaacatataatcccagcctgggctaagtgctgtgaagttccagacttgtgtctggctcggtgctgtatcctaagcaccttggcacttaagtggcattgaaatacttgctggaaagaaggccactctgaggaggtgatgtcagagctgaggcttggagggctggagttaaataaagatggtttcaggtcttctttgccttccctgtaggttctgcctctgcctcctctctggcactcaggctaagggtaagcatctccgactggccatcagccccaacatgccgagtacagggatcagatcctgtcttgcgtggccggtctcccctaggtcctgaacccagggaagtgcatgtggatctcaatttatctagatggtgcgtttgtgcctgccctcctttcgggcatgttctagaacagagttcagtccagagcccaggggtggccgggatgatggatgagggtgtggggcctgctgaccaccaggggacctgatcattgggctgggccagcctctctgtcctcattttcccctctgcaaagaaggggtgttgggcgtccctacttctcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactccttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttcccttccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggcggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagc

SEQ ID NO: 1869 - DNA, 5848 bp, Homo sapiens
gctttatatgagcttttatatttcacagaatggtgactttgcatatgccctggtgcattgtgggagctgctattgtcacgactaagacatttcttttggggtatccatctagccccagcctcgaaaggatggaagcagggcctccttgcaggaggtcatgttgtccatttgtctgctttcatacaagctggtccaaagaaagagttctctttcgtttggaacatctgttgggttggaagtccttccccaaatctatctgagtccttcttgctgcagagaaagccttcctgtgacctcatcctttcccctaaatgttgggaaatgctcctgagtcctgtccttgacacatacatcttccttgggttgagggatggggactgggacacatgctttgggaagggcaggtgcagagtgatggggctgacggggtgggggaagcagggggaggagctgtccctctgaggcctttgggaatcggctgtgccaggcatcctcagccctccagctaagcaacacagagagccaaaagaggctactagagacaagaaggccttcatggggccactgcttgtgggggatgtcagcagtggggaggagtgaagcaggaaggaaccgggagactggatggaattgctcccttcacacggtcacacatagccacacatggtcactgggaccagagtcagctctgtctgggcagccaggccctcagtgcaagccaccagcccatctggaggggattagtgctccggccaacaaggtcagctggccccttcctagctggagcctactcaaccttgccaggaagtcagagagctggacaagtggagcccagcctggggaggtggaagagagggaggatggagcatggtgaagcacaggtggcctttttggcagccccagccctggctttggaacagtctgggcagtgtgccaacccctcttgccactgtcgtcccattgaccctcatgaatgagttgcgaaggcagttaccttcagcctcctatggataaatattcgaggcccagagagggtaagagacctgcctgcgacccctcagcacttctgtttctctctggggtcttgagggtacaataaagacccctaaggcttcctcttctcgcaggaggtccaggcgcagctgtgggggagggtgcccttggtgtcttctgtccctgcagccagtctgctttctactcggcagctcctctctccctcctgggatgagatgtgcacgcgatgatgggattctgtaaatgggttgggaagaaggagttacctccttaaagggttagttctcccaggagtgctcgaatttctaaagggggcagggtcccacataaatctcactcagaagcaggattataagagttcctgcagcatcccttcccctttgctggtccctcttgagtgtgcaccctgttctaccagcggaacacctgcgggccagggtcactggagacagggccataccgtctgggcagtcacttaagtaacttcatcattctgagcaccccccttccttatctgaaaggtggggggccatccacccagctctcagggctgttaaggtgactaaatgggataatggttgtatcatccctgagcaaagggtatcacagatgggaagattatcttagctccgcagggagccagatgggctgtgagggaggggtaaaggcagggctggagggggctggaggggctggctgagcagggtatatatggggggggttcttcctcaaacccagaaaaactcttagttaggcttagtgtctttgttgagaaactgaggcccaaagaaaggaatttcttgtccctttgtttccctttccctgcctgaggtcattcattcacctaacaactttgtgcccgacactagacaaggccctagtgagcaaaatgaacatagcccctctgggaacacagagcctagatagggagatgatcatttcattactgcaaacacaaacatataatcccagcctgggctaagtgctgtgaagttccagacttgtgtctggctcggtgctgtatcctaagcaccttggcacttaagtggcattgaaatacttgctggaaagaaggccactctgaggaggtgatgtcagagctgaggcttggagggctggagttaaataaagatggtttcaggtcttctttgccttccctgtaggttctgcctctgcctcctctctggcactcaggctaagggtaagcatctccgactggccatcagccccaacatgccgagtacagggatcagatcctgtcttgcgtggccggtctcccctaggtcctgaacccagggaagtgcatgtggatctcaatttatctagatggtgcgtttgtgcctgccctcctttcgggcatgttctagaacagagttcagtccagagcccaggggtggccgggatgatggatgagggtgtggggcctgctgaccaccaggggacctgatcattgggctgggccagcctctctgtcctcattttcccctctgcaaagaaggggtgttgggcgtccctacttctcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttccctcccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagc

SEQ ID NO: 1870 - DNA, 2932 bp, Homo sapiens
ttcacatcagttactcattgagctggggttcgtcatattaaccaagaattcattcatctttcttttgatattgtaatcttgtcctcatctccacaactgagttggggcctgaggggtttaagagttctcactccatcacaggaggcaaggggtacccttgtgaaccagacttcaactcctggaagtcttgttcagttcataggcaaatatctttgcaagtttagtatgagacagcccaacggttaaataaataagacacagtgccatggttctaggcatttggagagggaaaaggcacattacacagattcccctggagaaaatacaggccattctcatcttctcaacatgcattttcccactcttcagtgacttttaatcttatcccctggtctatgagaaaccataacccacgtgctactgaatacatttttattttcccttcatgacatagacttggttccaagtatattttattttcctcccttatgcctacaagacatccaattttgttcaggtcccttttaatggcacttaataaatatacattctgagacctggcagaacaggctgtcccctttcacactgcctttaaagcgcctgtttgaactagctagtgcagagctcaggtggggcacgtcctagcttacagctcatggccatctctggcaccaggtctatctgtccaatactttgtgtctagggtagaggtccctaaccctggctgcacattggaagcacctgggaagctttctgaattcctgaggcccgagccacaccctaaaccaatttcatcagaatctctgggtgggacggagcctggattctgccagttgaaacctgccatggtaacttcagtgagcagctacactgagaactcctgagctacaattctagcacacagtaggccttcggtaggtatctgtggaacccacgagtgggtttcctatttcattatctgttcccctatgctctctatttttatcagaaatctgagcaggaaagagcagagagaatgagtcaagagcatcctctcaagtgaattcgctgctgagaaaggaaccgtagggcttgcatttctcttgtgtcatgcagtcttcatgctttaacaggcccagaggaggcaagttatagactgacacagacatgtatatatttcttaaaagcccttcaaaaaccagagctcactgcttaggcactatggttataacacagacatgttcttggaagcatatctaaactacctcctgtttgacacacattctaacttgggttggttacaaactttgtcagttgttaagatcacacttggtcacattttcccatttctgtgaatcttgcaacttatctttgcccagagcaacagcctagacatgaccaccccaagcagggactgcactgcacccaacattgccccagcaggtcagtcctccttgaacaggaactgtttttgaggggctccaatttccaggttctagaatggggtggctcacttaccaagttaaagaggctggctacatagaatgcagtattgagaagccccccaaggtagatcctgggttacaggaaagaaagctatactgatgaacaaggtttgctgccacaggcatgggcgtgggggagggcagcatgccgggggccaccccgagatcactgctgtcatttacatttgtatcacacttcacagtttacagggagctctgcatgcttagccccacgtcattctcagcacaaccctgtgagtgaggtctttctggatgggaacactgaagttgtgtcctacatctaaggtcccacagccaattgcatcacatccacggctgcctccaggacctcaggggccacctgaaaccactgggggttccccctggctccccttctaaccagaaacaggaaagcaagccattccctaacctccccacccaccaggccttatcaccgccttcccagagtttcctctatgatttgcatacccctttgttccctagtcctgagaacacagcagtagctgttcacctgctgccaacagcctcacacaccccacctaacacagtatcaaaatcccctcttccctggaacagcctctgaatttgcctacacacattccagaactatgacttggtcacacccactcccaggaccagtcaagagtcttgggaacctctctgctacaccgataaatccatggcttccccacttgagagggctcccagtgggtcactgcccaagataaactcagcttccagcatagagaaataaaagctgactcattggttatgatgtctcctgataccatgtgtaggaagtgaactgtctgaccaggcagttctggactcctccagaacccgcttcctgcaaccacacagcacgcaggtaacattatcccgtgtgacccacgcccacaggcaggcccggatgcaggcacagctaagactggccataacctatggagagtcctggccaatcagctgtgacctgctgtccaagtgcattgtgaccccaggtcggaatgagttctttatgcagacataatgagcagtcctggctggagcctcctgtgcccccaccacaccaagcactctgcgaggcccgcccatgtcttctggctgcctcctgagtgtgcttcacccaccctggcctggtcttcccttccacctccacctttcctttgcttcttttccccccagggtcagagcctctaagcctcccccatcatttggcaatgtaggctccaaagagggtaccctaagagggcagactccagccccacagaactgggctccgagcactggccaagaagccagaaggcacataacccctctgtccattcacttccaccaggctccactcagggttccccttcttgtcctgggcctccaggatggtcacaggctggcctgcctgcaggctcacttcatggctgcttctggcc

SEQ ID NO: 1871 - DNA, 353 bp, Homo sapiens
agagaggctgtttatcctgttcccatccacctggctctcgtccccattgctggatgctcgtcacctcccaagtacatcttttgtactaaaggcaatgactgcatctgctagtaccacagcccatactatgtgactggcactgtcctagcactctactgggtttgggttctcacaataattctatcattctatttgctgcatttttcagataagaaaaatgaggatcagagaagtcaaggaacttactcaaaattgcacagcagtgaatctaggcctgtctgacctccaaacagatatttttgatccactactgccacatcactgagcagactcagcaccctctccctctccag

SEQ ID NO: 1872 - DNA, 10876 bp, Homo sapiens
ggagcctaggcagccgagagggtgcccgaacctgagtctgagttgcggccacttcaggagctgagaggagcaggtaggtgaggagggagcgtgggctgcggggatggtgttcctgggggcctgagatatgagtaggggtcctgggagggggctcggggttccttggagacattttagcactagtggggaatggaatggcgtgtatggggaggtcctttttgtaccctgatcccaggaagtgaattcaggtgtgggtgggaggctccggagggtgctggtggtgggggatgggactccttgagaccctccctgtcccaggaacgggattcaggacttgggaaaaggatttcctgagccagtttgagctctaatggggaccttgaatgggggtttctgagatacctccttcccaaggagtaagcgcgggagggagctggggtttcttcagagacgctgtacctacaagacaggggctccaggctcgggtggggattgcagagacacccccaccccaggaaactcggtaggccacgggagggggtctttgatgaaggtctcagaaatagctcttcctccggaggggaaatgagggctcgggccaggttcctgagacaccccacaccccacacctaggaagtttctcaagtctggcagtgtctccaaattgacttctgccagaagatgagtgtttaagacttgctaggggccctggaaaagacctctaggccctagaattggggtcaaatgggagtccctgggtcatttctgtccctgggaaggggctcggttcgggcacttgtctttggcttctagtgaggatattcagagtcgtggcagagagcagtttgcagcgtctggggcaggggtctccgagtctgtccccaaccctcagctcactcaacaggttgcattagctctggtctcgggcttgggggcccaggcgggaaggaggggggtgagggcattaggaggggtggggcagccaggccgacacgtgtccctgcaaggagtgagccgcctggccacgcggtgagggtggagggaaggagagggggtggcgcgggggaccggggaatgaaagacacagatggcaagagagacagcgtgagtctggggtctgggaggagaggctatcccttctccacgtggtcggctcatctgcgctggggtccggctctctctgtagctttctgtctctctcttccccactatttctctctcactggctctctctgtgtctctctgagtaactaactgttggcttctctccttctctgatttttgttcttctctctctctcatctctttctctgtcagtctgcctccatttctatccctgtctgttcctgctcccctgccttgtctctttctccgtctttccatcggtctctatgggactcccctccccccttcttcagctcccctcactttgaagcatgctcgttccatctctgatccccccaccccatttctttgcccacaggatggaactgcaggatccaaagatgaatggagccctcccttcggatgctgtggggtgagtcaggggtccaaggaggtgggctcagggatcaggggttaggatttccctcttatcggcccctatttccctgccctatccagctacaggcaagaacgtgagggcttcctgcccagtcgtggtcctgctcctgggagcaagccggtccagttcatggatgtgagtggccccacaggatctgtcctggtggcaccttccccagctaatctcctcccgcactgctccctcttccccactcctcctcctccctgctgttcccctgcccagctatctccccagcacagctacacactacttggtcgctcccctctccagatactcctcttccccagatatgccctttccagctctctccctggccttgtttctccccacccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctgtgagtccataggtggcctgcggggccaggggtgttgtggggcaggtgggaggcctggggccaggtctgagctgtgccacctgccgcagggccctgctgctgtgcattgcgcttctgtcgtcctactccatccacctcctgctgacctgtgctggtattgcaggtgagacccagagcctggatcccagtccccactccacccctttggaccccagactctggagccacatccagagctcaacacagaccttggaccccagaccccagacccagctccctgaatgcagaccccagatcccggacccagcaccccagaacccacccccagaccactacactctacctctaacccccacccctcagtccccggttccccagctcctaccatggtctcagttcatagtctggctccaagacccctactcttacctccagccctcatccttttccctggcctcagatcccacctcccagactctgcccccaaactcaagcccaactgcttaacccccaccttcatcctccatcagtcaaagccggttcccccaagccccaactccccagctcctgggccctctggcctgcacctctggcctggcctcctggaccttcaaccctgttcctgactccccccgctaggcatccgagcctatgagcagctgggacagagggcattcgggcctgcggggaaggtagtggtggccacagtcatctgtctgcacaatgttgggggtgaggactctgggaggtgggggtcagcttggggggagagggcggagtgaggtgggcttccccaggctgggctggggaagacggggtgggggcatgaagagaatccttctgcttacacctcccccacctgcaccagccatgtccagttacctgttcatcatcaaatctgagctccccctggttatcggcaccttcctgtacatggaccccgaggggtgagtgagcaacaccccttggctggccagcagccccttgactctgcctgtgaggcccggtcagtatcttcagcgctgtgtgtgcagctgacttccagatgttctagtttgagactgctgggcaggccacttgggtcagactgattcctctgtgtgcctgttgctctgaccacaggagtccagtcgaccgtgtgctgattttgtgacttattctggctgcttctggctggaggctgactctttatgtccggtttactctgctgctgaccatgtgtgtgtgaatgtacatagccaatggactcagactctgcctgtgggtttgactctgcgtctgctgtcctggctgattctcttgggctagctctgtgattgactacagctgtgtcccgtatactgggattccaaccatatgtgtcttaccctcggtcactctgacttcccctgtccagctgattgtttgagcttgattctaggttcatctggctgaatctgtctagctgtgagtgtgtgatcactgactccgtctagctgtgagtgtgtgatcgctgactccagcagtgtgtctgtgtgcacgtagtatgctgtggtaccaactatgtgtgactcactctgactgtacgtgtccagccaactccatctctgtgtttgatttggtggctgttctggcaaattctctctggtgtgtgtgtgtgtgtgtgtgtgtgtgatccctgaatgtggctatgtgtcctctgtattatggttgcaaccatatatgctggactgttctgattatgcatctggctgactgtgtgtgagtccggatccgctgtgctggcttggtatgtgtggggggcatgtgcacgatgggactccagcagggctagtgtgtatgcacagtgtgttgcagtgcttgtgctccagctgcacgtgtgtagctgcctctgtgtgtttcatgaacagctctgtgtgtccagtggctaactctgcctctggtcccatgggctaactctgcctctggtcccatgggctttgcatggtgtgtagatgtgtctctggttttgtcagtctgactctggtctgtgtgacagtttttttttttttttgacagagtctcattctgtcgcccaggctggagtgcagtgacacgatctcagctcactgtaacctctgcctcccaggttcaagcgattctccttcctcagcctcctgagtaggtgggattacaggcatgcaccaccatgctcggttaattttttaattttatttttttgagacagagtcttactctgttgcccaggctggagtgcagtggcgccatcttggctcactgcaacctccacctcccaggttcaagccatccttctgcctcagcccccatgctcggctaatttttgtatttttagtagagacggggttttgccatgttggccaggctggtcttgaactcctgacctcaggtgatctgcttgccttggcctcccaaagtgctgggattataggcatgagccaccacacccggccagtctgacaattttaactgagtgcttgatctttactctctgtgtgtatccttttagatttttggtttgattctgagaacactagatagctgatagtgtgaccagagatgtctcattattatagttagctcccattggtttatttctgtgtaactgtatatgagatagaaagagaccatgtgaatgtctagaacataggcattcaatcaagttgttttgaatgcatgagcagttgttcagctgattctgtcttaactgactgtcttgcctggtcaccttcctccaatatctgtacagatcccaccttttctcagagcttggttccaacagtgtggccagctggatgatttcgtttctatttcagtctttctttggctgtgcagccaaatcagtccacaggcatactttcaggcatccaacaaaccttgagctgttcaaacaagcatgcatgtgtgtttctgactttttgatggactctgcatcgtggcttgtctactggatcatcagactgttgctctacctgtcagacataccacgatcgtgactcactctctttgtgtctggcaccttgtgttgcactgattttctcctttctttctttctctttctttctttctttctttctttctttctttctttctttctttctttctttctttctctctctttctttcttcctttctctttctttcctcccttccttcttttttttctttctttcttcctttttttttttttttttgagtgtcttgatctgtcacccaggctggagtgcaatggcgcgatcttggctcactgcaacctctgcctcctgggttcaagtgattctcctgcctcagcctcgcgagtagctgggattacaggcacgcgccaccatacctggctatttatctatttatttatttttttgagacagagtctccctttgtcgcccaggctggagtgcagtggcgtgatctcggctcactgcaagctccacctcccgggttcatgccattctcctgccttagcctcctgagtagctgggactacaggcactccccaccacgcctggctaatttgttttgtatttttagtagagacagggtttcaccatgttggccaggctggtctcaaactcctgaccttaggtgatccacccgcctcagcctcccaaagtgctgggattacaggcgtgagccaccacacctggcctggactgatttttacattgagtctgactgatttggggtgtttgaccttctggttgtgcaaccacttgcgaagtctgatggcaagttttgtccagctgtgtatgtgttagctgtgtcccactgatagtatctgacaatctcataatcagcttgactgtttttgtcaaccctattgtgccgtttgtcactgtgaccacctgaatgacttctcaagctgaggttgtcagcttaactctcctgacttagggcagaaagctgcctgtccagctgtcttctgtgagtgtctgcctgacagtttcctttggctggcagctaggcactgtgtcttcctgtctctctagggactggttcttgaagggaaacctcctcatcatcatcgtcagtgtgttaatcatcctgcccctcgccctcatgaaacacttgggtaagaggctccctgggttggccattgggtagtgggattagacagaagaagccagactgagaaaacccccattcattttcaagggctgcagcacactaggagagagcttatttgatgtgggcttgaacagattagtaggagtttgctatggaggggaggtttttctgggtggaagtagaagcttatgcaaaggtaactggggtgggtagaccttgaaggctagactaggtgtttggagttcactgttccgggggtccattgattttttgttttgttttgtttttttgagaccgagtctcactctgtcacccaggctggagtggtgcaatggcgtggtcttggctcactgcaacctctgcctcccggttcaagcgattctcctgcctcagcctcccgagtagctgggattacaggtgtatgcgccaccacacccagctaatttttgtatttttagtagagatggggctttgccatgttggccaggctggtctcgaactcctgacctcaggtgatccacccgcttaggcctcccaaagcgctaggattataggtgtgagccaccacgcctggctgatttctgagactctgtgttttgcccctcttaggctacctggggtacaccagtggtctctctctgacctgcatgctgtttttccttgtttcggtgagtcacagagaagcggggagagagtttgggacattgggacatagcttcctccatgacctggcttccctgctgcccccatcctcaggtcatctacaagaagttccaacttggctgtgctataggccacaatgaaacagcaatggagagtgaagctctcgtgggactccccagccaaggactcaacagcagctgtgaggcccagatgttcacagttgactcacaggtgtgtgtgcaggcatgtaggagattgcatcacactcaggccctctggttctgtcatatggtgcatcctgctcagagtggagctggatattggacattgggagcttctatgtgtctgatatggagggcgattacggggcgggagggggatgggaagaaggggatggacccctgttggctctaatcccatgtactcgggcattcccctagatgtcctacacagtgcccattatggcttttgcttttgtctgccaccctgaggtgctgcccatctatacggagctctgccggtgagtgggcaggcaagtgggcctgaatgatgggccagcaagtggggtggtaaccagaatgtctgacactccctacagcagtcctgggactgtcacttggtggaagctaggttgtgtcatgggaggggtttggggtggccaggaggtcttggggcactcagggtagtgactgtttgctgattggggcttaagtattctcctattttaatatccagcacaaatgtggatggacagagttgggaagcagagatcagatgatcagatggagggggtgatatgcatggctggtgatatggggatagggaggtacggacagacagaggcggaggcagggatgatatgatgggagatgtgtggatgatcagacagagggacagcatggatggtcagatggaagaggcagtggcagtcaaacgcaggggagagggagacagtcatatcgggggagatatggatggtcagagaggggattttggctagtcacaggggaggcagagacgggtgtccccatgtgtgccagctgaatggcagtctgggagaaggggactctggagggtggaggctggctttgagggacctggggcaagtctcagggtctgggcatgacagttccacgacctctacacctcaggccctccaagcgcaggatgcaggccgtggccaacgtgtccattggggccatgttctgcatgtatgggctcacagcaacctttggatacctcaccttctacagtgagtggggctggggctagggctggggggagggggaaggcctggggcaggagcctctgagctctttccttctgtgaccacggacctgtcagtttccaaacagaaggtgtgcctcacttgtgtggattttgtcactgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctgtgcgtggggcccacggctgagagggacatggatggatgggtagagggcataggcatggatgtgtgggtcaaggctggaaacaggagtggatggatggatgaaggaggcaaggatggacagacaggaaagggcagtgttttcagatggacagagatggcaaaaatcgataaacagaagtggggaggacatagatagcaggagagagagggtcaggggacagggtagtcagttggagggaggaggcacagatggatggctagaaagaagagggaggcaggaagggtcagttggagggtagaattaagaaacagggatggacagaaaaagggtggaggctgaagtgatgggatgtaggagggtcaagtctcccagatggggaggcagaactaattagacagaggagggaggtagaggtcagatggagagaggcagggagctcacacagggtggaaggatcggtggatggtcagacagaaggagaaggcaaagatggtcagctagaggaggaggcaaggatttcagacagtgggtgcaggtgccgatgggtgttcagacagaaggaagagacgtggattgtcagaggatggaggcaggaagcctgttcagaacatagagacacagatgttgggttaggcagggtggagccatagatagtcagagggaggggaaatcagggatctcagccagagggtggagctaaagacagatgatcacgtggaaggggggcagcacttgggtcctgacttctgtcccaccctactctggccacagatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcggtcagtaaacctcaccccagtcccataccccatctaatatgggccttgtccccaagtcaggttgactcctgtcccttcttcttgttctccagggtccacctcagcccccagcctcatcttcatcctccccagcatcttctacctccgcattgtaccctctgaggtggagcctttcttatcctggcccaagatccaggtaagcattccagggcagagctagggagagagggagcactccaaggagggagtgctcactccaggatggctggaggtgaaagggacatgcataggagggggctgggagagcatctgaaagaatggtctggaagaatgaaggtgattgtctaggaaggggcagaggagacagagcaccagcagggtccaggaagacagggagcactcaaacagaggctggcatagagggagcattctccagacagatggaaagagcactattgggaagagagctggaagcactttgaagaaggaggatggaggaacgtattctgtcatgggtcctgggaaggtggaaggactcgcagaaaggggctggctgtaaggaaggagagggcatacagaggagggtcaggaatggatggagcactctctgaaggaggtggaagacttgaggaacattctcagaaggcaactgggtgaggagtcccaaccagccccatcttgtctctctggcccacaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 1873 - DNA, 742 bp, Homo sapiens
tggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaag

SEQ ID NO: 1874 - DNA, 1340 bp, Homo sapiens
acagcagagatctgtggagtaggattgtgggctggcagtgggtttatcccacagacctaagacagctacttaatttgtatagacccttcccagcctgggcctctgggttttccttctgggtggagatcatcttctgtaggaaatggaactgcttcaagccaagaagcttttacttttactaggtctttttgtgtcctgctgttcaaatattaggaagactgaaccctgtttcggtcttgacagtattacgtttcgtgatcccaaaaaaaagtgtttgtgtaacctcaagtcatgctgaaagtgaaatacagcttaaagtgggattctgctggacctgactcaacttttcacctcaccgcttggctccgtgcaggcagtatttgagtatgtggttccccctcaagtctgtaggagttgtattgtcaataaagtccaaggccagagtgcttgctttctagtaagtagagagaatttttgaaattcaacgacaaacatttattaagcccttattgtgtacagggctcaaagctaagtgctttgggtgattcagggtgattagggataggattccatcttcaagaagcctcccatctaggaagaaaggtcgataagcatagttttggacacacgggagagcatggctttctctgggcccagtaattactttggtatccagatcattagagaacggaatgccttctattgaactatgtaacagtcacaggtttagatcttctcaagttattattgcctttaatcttcatatgattcctatcctgcagttaggaaatggaaaccctaggatatagtgactgtgagctcagaaaattaggttgggagataagccagtagattgaggtggtagattcttcaagatcttgaaggggggaaggtgggggggggggacgggggagctgttcccagctatatttgcccttggcagatgggatggattctgggagaaagctctaagaaattaggcctgtacgacttattttcatgaatctagctgctaagctggaataagtgaagttaaaagtagtgatgggccaggcacggtggctcacacctgtaatcccagttctttggaaggctgaggcaggcggatcatgaggtcaggagttccagaccagcctggtcagcatggtgaaaccccgtctctactaaaaatataaaaattagccaggcatagtggcacgtgcctgtaatcccagctactcaggaggctgaggcgggagaatcccttgaacctgggtggcaggggttgcagtgagctgagatcgtgccactgcactccagcctgggtgacagaatgagactccgtcttaaaaaaaaaaaaa

SEQ ID NO: 1875 - DNA, 147 bp, Homo sapiens
acgcctgtaagcccagctactcaggaggctgaggcaggagaatcgcttgaacccgggaggcggaggttgcagtgagctgagatcgtgccactgcactccagcctgggtgacagagtgagactccatctcaaaaaataaaaataaaaa

SEQ ID NO: 1876 - DNA, 590 bp, Homo sapiens
ctattttcaaggagttcacttacactcagggaccctaggaacatttaaaggataattttattgtcataatctgcccttaacaaaattaacaaaatgaccctcaaaatttgctgattcagccattcctagcaatgaaaggaggaacctggctacctaccagacttcttatttctggtgtacttggttcttggtgacctctaggcaggcagcaccccagcagggctggactgtgtgtgctccctggaaggctgacatttccggagtgtgaatgctggcagtaagacatcggaagcatcttcctctttgagtgtgccaactcttggccaaagatagctctagaaattgtaagaactttgagagcagattctgtttgtcctatagaaaactcccatcagcatattgcctctacatccagctagaatgtgtcagatttcacatgttcattcatagtctcaaccactcttttttcccccctctctttttatctttttccagttttttgtttgttttatctcttcatcacggtgaatggggttcttacagcttagagttgtcttgtttgtgtgtactcatgctcttgaaggaagggg

SEQ ID NO: 1877 - DNA, 16772 bp, Homo sapiens
cggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtgagtagaccccattgcctagaatgcctttggcttcactttgttccagctcaaaacttctagcagaggtgggaaagggcaagaaagcagttgggcttcttgtctgagtgaagcggtccctatccctggcatattttaggcctgtggttttggaccgtgagaccaggtcacatctctttgcaacacccttccctcccagtgttttgtcttttcagaaggaaagggtaggaacatttggtcatgcaatcagcctttcccattcaggctcttctcacatactggtttccaatgacttccctttgggattagctatactttgtggcaaggtaggaaaggataatctggctgctgtgatactaacacaatgttgttttatttgggggtgggggggtctcaaccccttatttcccacaagcagctggggcattctctgtacctcattagacacactgttagagtcccaacactactgcttctttcttcaagctttagctccagggagtaggtaagaagagcctccctgccctcacctctgaagtgatgagaaggtgctgtcattctgttctgggatagagagctcttgatattaagtcatttatcagagaggcactgccatagatgtagaacccatctagatccccactgagttcaaagactagtgatgaggagccagacccattaacaggaacaggtggatgtgaggacagaaagcatcaccctgaggtcatcctgactcagtctacacaatacacacagaactgtggagggaggcataaagcttgggaaaccctgcccttacagtttctagagtaggagacccttcatttccccagtcagtgctgtggggctgtgatggggagatcagttatctaaccctagccctggggagtgggaagggcctgatgctgcctgcacatctggctttgttggtgcctgtgggtagcctgtagcagagaagaatcatccctccaggctgcttctggaatcaattcagtccaagtttgaccccaaaagtttttgcatcaaaataggatctagtgtacatagagaagtacactgagttgcatgtggtaggaacaatgagatcaagaaaagatgggcatcctagcctcttagcccttaaatatgaactgagtcatagaggcctgaagctgtgctcaaccccctggaccctggctccccattccaggatagagtggggggtactgatacaaggcttttggaataggatgagttcctatgaggagaaagcacaggtgagacaagaattctaagtgataactcttgagttgaggttgaaattgtggagaaggccaaataggtcaggaatggccagctaccatattaagggagtaagagagctcctaagatggagctgaactgtgggcactctgaccaggagctctagcaagacagaattctctgggtcttaccttcgtaagaactcaatttcaattgttctcccttccagccagagtccactcattcaataaatatttattgagtgcttgttccatgccagatagtcctttgttctgtctgtcctcatagattgcagttactctccctggttgccctaatcctcggccacaccctccctctaccagtcctttctggtctctagtttcaaagtccggttttctctaagctggcagagaggattctctgccttcctgtcatcccatcctttgtcttccctcttctttccacccctagaatgtgctgtccctttttattttattattattttttttttgagacagtcttgctcttgtcacccaggctggagtacaatggtgcaatctcagctcagtgcaacctccgtctcctgggttcaagcgattctcctgcctcagcctcctgagtagctgggattgcaggtgcctgccaccacagctggctaatgtttttgtatttttagtagagacggggtttcaccacattggccaggctggtcttgaactcctgacctcacgtgatccgcccacctcggcctctcaaagtgctgggattacaggtgtgagccaccgtgcctggccgctgtccctattcattaatcacatttcttctcctctgctccagtctgttatctctcttgtgccccatcatttgtatgttcattcatctgtaaaattggcaaatatgcattgactgcagaccatatgtcctaccctgtgcttggacctgagggtaatattcagctagtctttgtcattgtccctttccccaaggaacttaaaagtatgtcagcctcacatgaggaacattgaaataacaaggcaatgtctgattaggaattgagataacagtttgtatatatgagtaataatcatacctgtactttatggctttcttatctattatgtcatttgatctttcaaccatttcattagatagctagagcaggtggtatccccattttgtagatgaggaaactgggacttaggggttacttacccaattatttggttagaagtggtgtgactgaacagtaggcataatgtggcagtaggcaggagagtggaaatgggaaagagtctggcagggcaggggctacttagtgaggacccatctggaatgagaatttgtaggaaataagattagaagataggctgggacagatgtcagagccttgaaaacagaatcgtttgcctattgaaaacagcctcaatcatttgcctcttggatatagggctgtaccaagcccaggaaaatgttgggattttttgaaggctttaccaagagcaaaatcagaaagcttcacagtttaaatgttgaatttaaaaaaaaaaaaaaaaaaggcttgagaggaaatgtccagaaataaatataaacactgattgtctatgggtgagattatttttttccccctttcacctttcataattagaaagaaaaatgatcattttaaaaagaagaaaggccagaagcggtagctcacgcctctaatcccagcactttgggaggccgaggcgggcggatcacctgaggtcaggagttcaagaccagcctggctaacatggtgaaaccccatctctactaaaaacacaaaaaaatgtgccaggcatggtggcgggcacctgtaatcccagctacttgggaggctgaggcagaagaatttcttgaacttgggaggcggagtttgcagtgagccaagaccgagccactgcactccagcctggacaacaaggaacgaaactctgtctcaaaaaaaaaataataaataataaaaataaagataagaaagttattcccagcagcctatgcctgttttggaggtaggggattgggggcggaggctgtaggccaggaaaccataaatggtcctttcagcacgtcagacagaagctcctgatgttggaaataaagcagtggtggtggtgctagagaggtaaggagagatcagaaagccccttctgaggagaacaaaggagagaaacaaagccactccttcacttcagctggggtgactgggaagatgaagggaccttgaactgtatagaaatcaagaggaagaaaggtttgaaagcagatgtccttgggacatttaatgggaggtcacagagagaggcaggtgactcagcctgtgaacagctgcccacctgcccccttccactcacattgcctcttgctcctcaggtacctgcagtggtggtaccggaagacccatgtggaaaagaagacacctttcatcgacatgatcaattctgtacccctaagacagatttatggtgagccccaccccatctctgctctgctcagagaaggcctagcctccaggtctaccacagttaggaagagacttccagcttatgcaaattgcactgttccatcccctaggttttcagaggaaccaggctttatagtctagaaagttagaaatgggcttattttcctctcccaataccccactaaccaccctgatttctctaggttgtcccttgggtggcatcgggggaggcactattacccgtggctggagaggccagttctgtcgttggcagcttaaccctggaatgtatcagcaccggacagtcatcgctgaccaagtaagagccaggaggtggagaggccaggacaatacctccccaggccaagaaggaaggacctcttggctagtgtagaaggtagcagttagatgtgaataagattcaatctaataagtactctcgggatgcttcctgtgtgcccagccctgagctaggatataccgtaggaataagacacacacaagcacacattccttgaaagagtaaacagatctggcatttctctagtaaatgcctcctgtctacctcactgccccaacccaactagctgaggcagcccccaaccacagagaatgcagagaattcccaaatcacttaacctgcctgaaagaacattttgtaggactggaagggaaaagaaaacccaaagtctataaactcatgggaaaaaaagacacgtagtacaaggttcctcaccctgattgaggaaccttcaccaaagttcagctcctctgctgatcactcccctggaggtctcctggcttagggtctaaaaagctccttctctcccaggcttagatctctagccttcttccctcttctgaagcttcacttttttccttttgctcctgcatcacatctgggccttaaattgccagaagtatgtgtcctgcctctcatcatctctctctagttgaccgcccctttagagttgcctaggaagttcctctttcttggctccagcattcagcctcatcttcaaaggaaaaatgactagcaaatctttagtccaattaatgacaatacccttcctggttcacgtttaccagccctgcccatgtcccaagatccctctctgcctcatcccttaggtatcctgaggggaatggcttccagaattgtgactctacaattaaagtaattattgcatgcttaacatgtgctagacactgtgctaggctctttgtatactgtttaatattaaaaacaatcctacaagggaagtaccactattatgctcattttgcagatgaggacactaagatccagagaggtttagtaacatgcgcaaggtcacaaggttggtaaatggaaaggttgggattcagaaccatttctttctggggtgaagagcttgtggtcttaaccattatgtaccattccaacaaaatgaaaaattattttatacagttgtccctcagtatccatggggggttgggcccaggacctgctatccgaggatgctcaagtctttgatttgaaatggcttatagtatttgcaaataaccattgcacatcctcctatatactttaaatcatctgtagattacttataatacctcatacattgttacataaacccttgttgtgccgtacagtaaataaagtgtgtacatattcggtacagacacaactttttttccacatattttagatttggttggttgaatccactgatgtggaactcacagatatggagagcccactgtatacaataaaaatatttgacatagtttgaaccagggaaagggatattaatccctcatagctcctaccctccaagagctaaaactttttttgagaaaataagacttaggggaaatggagactgtgagaccacatcagtgctaaaaggagaggggtggatagtatactgtggaaaaagggacggtgctgcagatttcgctcattccctccacatacatgccaactctgaagaagggtgcatcagtgaattaaaaaatgtccctaccctcagaagaatccatacagcagtcagggacacagaatggtcagtcaatacattataacataatacaccaaatgctagaatagaaggggaggggggcacacataatgactcactgctggaagaagtagaggaggaagagatggcttttgacctaggctttgaaggatgagaggtttcaccagatagcgaacaagcatgagcacaggcatggaggagagaatgtagtgtgctcaaggaacagtgagtgtttttatatgaacagactataggtgcttgaacaggtgatgagtctgatgggcagggagaggccagctcaagaagggccttgaaagccaggcaagagttgagactttagcctgagggccatggggagtcactgaaacatcctaaccaaggactgacatatcttgatttgcctgtgagaaagatcactctgctacccagatgaaaagggccacagaaaaagcaggagattgggcttaagtgaggtgctaacaccaccgtagtggagaagggagagaaagcttgggagatagatggatggggaggtagcaggacttggtgattcactgagcctgggggatgacttgaagctgatggtgcagtggtaacagttgcaggctctgaaaggggaggagctgatttgaggagagggaagacttagtctgtggtccctgtggtttaccccgttccagcctatctgccctcttaagttcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggtgaggcccccacatctgtatcttccattgccctcccttccccaggacctgcctctgctagaaactgcatggcctgcgaggcgcggtagctcacgcctgtaatcccaacactttgggaggccaaggcaggcggatcatgagatcaggagatcgagaccatcctggctaacacgtgaaaccccatatctactaaaaatacaaaaaaaaaaattagctgggcgttgtggcaggcacctgtagtcccagctactcgggaggctgaggcaggataatggtgtgaacccgggaggcggagcttgcagtgagccgagattgcgccaccgcaccccccaaaaaaaaaaaaaaagaaactgcatggcctgtgaaagggaggttggagccatgaacatcacactggcttcccagaaccaccgcccaactggttctggtcttctatattccctgctaggcagcttgcctgggaatatggggagatgcaagtggacaaaagaagagtacactggggagtatttgagtcaggtcctctgtgtgcccaggactgatcctagcagagtggggtcaggaggcgctctactgggaccgtctgagtctaatcttctgcccccaggacagcagcctgcctgtaggagtctttgtgtgggatgtggaaaatgaaggggacgaagctctagatgtgtccatcatgttctccatgcggaatggactgggtggtggagacgatgccccaggggtttgtggaatgagcccttctgtctggagcgtagcggggaaactgtccgggggctgctcctgcatcatccaacccttccaaacccctacacgatggctgtggctgcacgagtcacggtaaggaaagagcctgccctataccttagcccctgaaccccacctccaccccagcatggtctcttcatccaccctcatcatactcctgtaagcccctgggcctgggaggttaagagtaagtaagaggagctggggagctagccgggacccagtgtactcgtggagcctgccctcacagtccctgaccccttcacaggcagctaccacggtaacccacatcacagcctttgaccctgacagcacggggcagcaggtgtggcaggatctacttcaggatggacagctggactctcccactggtgatggggggtctgactgggagatggtgggaagagaggttgtccctgtcttgggaccaggggtgggaggcctggtaataagtaggccttgtttccatgttagggatccctatccctggggctgaaggggctcctgtcctgaattctcttgtgtttctctcaggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggtgaggggaccaagaaagtgtaaggatccagagtgctggggctctgacctggggcttgtgttcatccttccccttcccaccccaggcggtatacaaggttctttggccaggatggagatgcagcacctgccctcagccactatgcactgtgccgatacgcagagtgggaagagaggatctcagcttggcagagcccggtattggatgacaggtgccagtggggcccatttcttgcctttctcctgggcactcactccaaatgggactcctcgatttactctccacccaccaaagtcagtagacttgcactgggattcatttgatgatcccactctgctgaacccccaaatcctttccatcttgggaggtacatgttccttaaaccatttcctcctcctcgcttcccagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggtacaggatgctggtgggctgggatatggcaggccatccccaagtcaggatgatggatttgcctaccccagggtattggttaggatgagggggtgttgggtgtggactagtaacaatgccccacctctaaatctagaggacaagctacagaggggtttgaaggggaagcaggaattctggcaacagtgtgtctcattcattcctccaggccaggagtaccgcatgtacaacacatatgatgtccacttttatgcttcctttgccctcatcatgctctggcccaaacttgagctcagcctacagtatgacatgggtgaggatcccttttgtgccgcttctgccctcttggctccccatacccccgaacttctgtggtccctcagattgtctcttctttcccttcccttcatacgtatctgcatgctgcttactggttccccactgcagtcacacacatagctgtgtgcccctcctcaggcatgcccattccctgcctcccttctgtgtctctcccccagctctggccactctcagggaggacctgacacggcgacggtacctgatgagtggggtgatggcacctgtgaaaaggaggaacgtcatcccccatgatattggggacccaggtaaaagtccaccccaaggtcagcttccctccctcaacttttgcaccctctaccctatccaccaatgcaagtgacccaagtcccctcctctcccacagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagtaagggatgcacatgcagtggccagtgtgccaggggtatggttggtgtctgggaagagcctagctggttgttgcctttcctcggtacctaggtcttcaacatcttggtccctctctaggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgagagaggaggaggagcagccagagagaaaaatgggttttccctggaggtgggaagtaagtatatgagaccatgttcctgcccttgcccctccaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagccattaagtgtggtgtgtttgagccctcagtcgtcctgacagggcacaggagctgcggccagcccttgcccaccgctttttatttggacacagatggggagccccccaggctcctgctgagaccccccacatatcctcatatctagcctgagtatctgtcctgcaaaatgacagaggggctaccagtaggaagccatcctcccttccttgtgagatttgcctgcagggggaggatgggacctcggcagagaggctctgagaagaggtcagggaatggccactccaggggaggctctgcactgggagcctgaggcatgtaatgcagcaggcaggaagtgttgccaggggcctggagtacacagtctgagccgtccaaccactggtgtgtgctgtctttcggcacttctgactgcagggcaggcagctccagctggtaagggtcctcactggggagggcacgaagctggcgggacaacactgaggagacaaagaatcttcagaggccaacccagacctctccccttgccctgtctgagagctatccttaagcctcttacctccatgctcagctggcaggctcccccttgtgtcagaggagtacatagcaggtacaaggaggaggcagaaggagactagtaggacctagagcacaggaaaaaggagatgaagaagggctctggattgccctgtccccaccaactgagaaaaggatttctcccctcatcaccatcctcaccaagatgcaggtgctgctgctgctggttttgtttgatatctcaatcaccatggcctggagtttcctcagttgatctagaagggacctagaggaagagaggggccaatagtgagcatcccctggcctagcatcctgagacacagtgaaactcctgttcaggccacctcctccatctctgcactggatcctctctcttacttttcattctatttttgcaaacgacttcttcctctctggacaaaatgcctgaagttcctcattaaaacaacaacaacaacaaaaagcaaaaacaaaacaaaacaaaaaaactctgccaggacttaacctcctttgcgaatatcatcagtcgttccccactgtctgatcagctatgcacataatcctcaccaggcattttctatgttctctaccttctgtcccagctcatgtgtgttaagagttccagcccaagatgactatgctggactagtcctcttgcctaggatgctttctctctgcctagaatgctttcccaacccaaccccagaatcctaactactatgaaagcccatgacgtctttcttaccccctttctttttcttggtacttaacttattcttagttacttgtaaatgtattcctcactactgggagcttcttggaatcagagacctagtgaaggcagctgcccagttagaaatcaagtgtagggcaggggaaagagtgagaaagcattaaatgaggggcataggaagggaatggtttggagggatacttacaaattctgttcctccagaagctgtactttgttctgaagctccatattctgggctgtgtatttcaagaccctgggggaaataacaaagatacggggatatggcctgtatcctcccttcaaaaacctaatacttacaacagagtccctctccctttcatacctgctctctaaacccccaacatacaccttctttttcctgcggctctcttgagcagatcttttatttcgaatcttcctccgcacacgtttcagaatttgttcctctgtctgaaaggaaacagggaaagggatatcattagaggaactctagaaaaaggagttgaaacgcaactgagatcaatctctttccaatacagaaatcccttctacagcttccctgaccaacaggcattcagattctttctgaatgcctccacggaccaggtgttaaccctaacaagccagaccattttaaactattaaaaaaaaaactggtcgggcagtattcaggcgacgtggctcatgcctgtaatcccaacactttggggagctaagacaggaggaccggttgagcccaggagtttgagaccagcctgagcaacatagtgagaccttgtctctactaaaaataaaaaattagccgggtgtggtggcacatgcctgtggtccctgctactcaggagactgaggaaggaggatcacttgagcctgagaggttgaagctgtagtgagccatgatctcgccactattctccaacctgggcaataaagcaagaacctgtcttcaaacaagcaaataaaaacttccttatcctgaaccaacagctgcctccttataatttctatccgttggacttacctagtatctctggggccaaatagaataaaccctgtttagctattttaaggcacttaacatttcctcagagcttaaagaaaaaaaaaaagacaaaatttttaactcatcttctcaggatagactgcatcctcttagtatctgtcaaagatgtgctctagccagtatcaaggaaagcaagagagtgacttgtagagacaataactctattgctacagtttccaaatcccatgaactttcttagtagccacatcacactgctgactcatcttgtactttgaagaaattaaaattcttcactttgggaggccaaggtgggtagatcacttgagcccaggagttcgagaccagcctggcaacaaggcaaaaccccatttctactaaaaataccaaaaaaaaaattgccgggcagggtagtgtgcacctgtagtctcagctactcgggaggctgaggtgggagaatcacctaagcccagaaagtcaaggctgcagtgagccatgatcacatcagtgcactccagcctgggcaacagagcaagaccttgtcaaaaaatatatatatattcctgtaacctttctattaatgagcactgatttcatcatagtaccccagtactctgcttgtgaagttgccactcattgcttaaaactgaaaactaaggattttacatttattcatgtactgcttagtccaaccctgttgaactctctaaacagttctaccattcagcaagaggtggattactatgaagccaacgaagtgtcaaggcccttcacttacacagtcctttccaaggcccaatactaatgttgcactgataattttgagttatttttttaacagaacaccaaaatttgtataagcccaacaaaaacgaggatctgcccttgcatctggcatattgtgtacctgcctcaacttcctattagcaataaatctactaagtttctcacctcaatccttttttaaagttattgatataaagttaacagaatttgcctacttgggacttttaatcccttttcagcctttgttcaaccaatgagagtcttaccttagtgagaggaagtgtctcaggcagaataagcccctccttctccaatagactcttctcctcatctgtcagtactagcctagcaatctcctagggtaacaagaaagtggacggcagttgcatggggatgtcagagaggaatggggaatcctgcccccacctggggaatgtgagagtaatctcctgaaaatcaagtcaagtacctgctctgccagctcctccatatgctgtggagtcatctgggtcccctcttttctacagctctcactctctgcaaaagggaaagtatgaatagccaggcccatgaaccctgtcctccccgcaaacttatttcagactcacctagatccatagagacagtttcccgtgggagggagtaggtgtggtcatggtggacaaggcaggggttggaggagctgagaatgttcaacgacgctgggggactcagcagggagcacagcaaatcatctacttcccagtcgctcggtacctgcgcagggttccaatgaacaggccttgaccttatcaccatcacctgacttcatggacatcccacgctttccccagtcagaaccccaacctacctcagaaagcggcagcgcccagtccagtggggccctcacggcctcatcgggtgccgtccccaaatctccactttcctctagcaggaaggccagcaggtcttggtcaccagcatccaattccagctccatttgggacaactacggaaagggtgggccaccgggccccaacgtccgaagcccagacacgagccccaggccagctgtaggcctcgggcacctatccactgtccctctacggccgggattccccgccggcggctttccatagccctctccggacccgcctcccaggctcaattctcctcagcctccaacgcagcgaaagtgacgcaccccaccccgtggcactgtgggacttggagttccctccaactgagaagaggcttgggtgcagcgccacgtcccaggggctatgcaaatgtaggggacggccctgctgccgcctcgcaccccgagggcgggggttccggggctccggctccgccttctaccccaagctagaaaaaggaagagttctagcctgaaagggaactcgggcgtcgtcctggcgtcctctccggattgcg

SEQ ID NO: 1878 - DNA, 3118 bp, Homo sapiens
gaagggagggcgaggccggagcccgagggcgacccgagaagcggcggggcggcgggccggcgggcggggcgcagagccaggcagcgcaggtaggccagaccgggccgggcgggggccttagggtggggccgcggggcctggccccggggcgggcgggccctgcctctcttgcgtgtccggttcgggtcctattagttggagaggtcagcgtccagcgcatctcggcttgagctcggcgtgaagtaggccgtcttggggaagacaggcctttcctgggagcagtcctatgtctgggataggctttggggagcgtgaggagtcgggtggcagcggggcgcagggcggggacgggctttggtgttagctgatagcgggcatgtgggtaggaaagctttgggtgagttggggattaggtggggtccgtttaggaatcaagggtcgctataggagttaaaagctggggttaaaacttaagagttagtgtgagtcaggtccgttttagataggtaaggtttagattacggtcattatcttgtttgctgggatggccatcatacgtcataatttgagttcagggtcaggttaagggtcaacaaacaacaggaatcaggttagagcttgtttgagggattaaagaatgttggcatggtcggtgttaaggataaacagtgaaagcgtgagttaggaatcaaattataaatgaactttaggcttaggggtcaacatttagggttaacatcaggggatttggtgctaaaggcaaaacttagatcagtttcagggatcagggattggatatgagtctgtgctaggaaagggatgaatgtccaagccggtactgggaatcaggaaacaaattagaggtggggttaatgttaggaatttggggcagctttaggggttgtggtttgaggctagcatagttgaccttgagcagataaaatttaagaggttggcagtaggtaaatgcccttcttttgtagggaaatcctttattcctatgtagttacaggggcttctttttacccagagagataaactaatttcaggctagcgttctggctttagctagaattgcaggcatctgggattccagcttctttattccattctctaagcccaaggcccttgctgtggccaccacagttaggggacagagattctggactgtgttgtttacagacaacataggtgggaaatagggacccaggatgtacaaggcctagtcacaagttggggactgcctagggaagaaggagctgatgactatgggggaagctaaccaaggaatcactgttgccatgggagaagggaataactgaatcccctgaaagtttagccctgcttctcccacttcacttgttctcttggtattaagccctcctctccaactctcatccctgactctgcatttcacacccatcctgcctatccccttacaaaatacttcccttgcctttaactctcccatgctcatcttatcatccgttcccatccttagttctacctccctcaccaacctttaatccgcacatcctacctgaatttaccctcatcaaaacctgagctttcccatcattttaaattactctcctaccattttcacccagtcatgtacctacattccacctggtcatctgctgaataccctactcccatcccctgctgtgtgtcaccccctggatctaagcctcttttaatttcttggaccatttgtagatccccttcccccactccccaacagaaaagaggaaacgagacccaaagaggaaactgggtcttgctgatcccacgcccagccaggccactgaccacacccccacttcactcccagcctgaccctgccactgaccacagcactatcctctactcagcctgacccagccactggctgtaccccatcccccatcccagctccagctttacttagacattgccaatgtcccttcactttcccacccccaccccagtctgatttagtgactgaccacaggcccagctcttctcaacctcctatagcctgacctggcctctgacctcaccccatcattccctgacttagccaccatccatgtaatcattccccttcccccaacctgatgcagtgactggtcatatatgtatcttatgtatatgtatttttccaaacaccatcatcaccagcattctttttctacaccctgtcttctcatcctttttctacaccctgtcttccccattcccagcctgatgcagtcactaacccaaccccatctgcccctagtggctactaatcatatactcataccctttttccccacagcctaaccacatcccgtaaccacagcctcatcctcacattctctgcccaacctgatcctttcccctcttcccaattcgtcgcctaaactcaagctgccccagccgctaaagtggctgctgatgataggaagctgtgggactctaacctgtctaccttagtagttattaggtcctgtcatttctacctccccaaacttgttctgagtgacatcttcctcaatgccattccaactccggcttcattacctttaatttgtactaatacagtgtccttctaactaatctccaaggtaactgccagagttatttttctaaaatccagttccggttatgtctcttctctgctcaaagactcccttggcttccttttgtcctccaataagtaaaattcctcatacccctctccagtcttcctctgcctttccatcctaaccctgacttccccaccactgctcccttgcaggtacccctgtgcttcaacagcctgcctgctcacttccctgaatgctcctccacgatttactgcttctccatctttgcttatgctatttctctgcctggagtgaaaactacccctgacacatctccagctggctggcgtagtggagaaagcttgggctttgcagtcagaaacctgggttcggatcctggcttcacaacttattatttggagaagtatttgaacaagtatttaacatctttgagtctgttttctgatctgtaaaaatggaaataatgacacctactgtaaggattaaatgaaattatgtatacaatgcaagtgacatagtcaataaatggcagatcactattgttt

SEQ ID NO: 1879 - DNA, 10231 bp, Homo sapiens
ttttttttttttttttttttttttttttggagacagggtctccctctgtcacccaggctggagtgcagtgcagtgatgcaatctcggctcactggagcctcagcctcccaggttccagtgattctcccatcccagcctccagagtagctgggattacaggaacgcgccaccacacccagctaatttttgtatttttagagacagggtttcaccatgttggccaggctggtctcaaactcctggtctcaagcaatctgcctgcctcggcctccccaaatgttgggattacaggtgtgagccactgtgcccagtccatcatctattgtctgtaataatttagaaatctggcaccaggattatgaaattcactatacagtgtgtggcataacaccaagcttaaatggtcactcagtggacttcacaataatggccactttatgcttctggatgcaaaacgttgggagagtttgaagtggatatgaatttgagaatgcgttttcttgtaggaaaagtaatggaaacataagcatctttttctaatcacaggaaaggttaaggctttggtgaaagcaagcataactgagtttaaaaacagtctagaataagaaaagggtaatagaagaggaaggaaggcagaagtggaccatgcagaataaacaatcaagcctagcttttttaaaaacctgaggtcttactaaagagaaaggaggaaaaacggaagatttcaacataagagtgttaaaggtggaaaagagccagaaaggactgtgggcttaaaaaaaaaaaatcagtgaagcagtagtggtgtatgttggcaaagagaagtgtagagttgagaggagggagagaatttatagtagaggaagtcggtgtgaagttttcctctcaagatgcccagcagagcaaagaaggaatgaaggcaaaggccactgggaatagagtagggctggggctaaaacagcacgggagagtgcaacagggcccaaagtaagacattttcttttcttttcttttttttttcattaattgacccagatttgcttgtttgggaccaaaggcaatgcagagtttagggatctttataatttataaagtaatcacctttggcccaacataacacagatcataaggatcatggcagaattcgtctctgagacaagtacaaaataccattttagagttgattttagaagagaagtcagactaataaattgctgtgttgtagaaatactatggtgaattaaacagctttaactttttctatcagccacaggataaatacagaaactgtataattacatacacatccacagaagatagtagcctcatatgctaaaattgtgagttgtttgtctgtatactgtagtccaaagctcccattccaagaaatgttttatttggttcaaaatataaagggcaggttagagggctacacagaaaaaaggctaaaaataaagacagtaaaatgagggagaggaaaagtggaagtgcagcactactgatccagaaaaactgaggcatcagccacaaagaattcaatcaagtcagtgaggggcaaatggcacaaaagccaaacaagaaaaaggctgaataccatattaccaatctgagagcctcacttttggttttaagtcaaatattgaattagattgtgcaacttttctatttttatttttttatttttaaaaatccaccaaaattacttaaatcatttgacagagtcatacaattttaaatgactataaaaatgtgcagatcagtgccaaattttttggcaaaggctgaatggcagacagtaatccaagacgcagacaaccttgcttttaagccatccgttacacagagaccagcaggctcccttctacctgtgagaccaaataatcccaaaatgtaaccaaataatcataactccccctactcctaaaacctacccttcacccttcactgtctacgtcagcctctggacagacctgatgcctggggtttggccatttccgccttcccaccctgtgttggtctccctcctccctcctcaggtccctcagttctcccaggcctaacttggcgtgcttccttcctctctcaccccaatcaatccggctctccttccctttctgggttacgccacctgcccgactcccggtttccccctcgggggcccctccttgccctggggtctgctctcggcccgccaagttctcccaggggatccctccccacctgcctccatacagtcagactgtgttcagtgtccgtttcgcgcccgtagcgacaccacgacagaagcccactaagtgaccctctgctcccagaaaccctcctggctcctccagaccctccggggctctggcccgcagctcccctctccctccggcggcgggggtcggctgtgactcaccagagggccagcggccggggttggggtgggggggccggaatgctctcacttcctctccgcgcacctgccccgaggctggagcgccgcccggccgggcctccggcggatgttttccttgttcccaagcgtgtagtgcgcgccagccgccccctccgggacctgcgcgccagccaccgcgcccccaggacccagcgggcctggtcctcaccactcaccccctccccagcaggcacgcatgcgggctcgacccacacctctgcaccgccccccaacttctgggagaggactcctggctcagcccagcctctagctttccagaagcccctatatgcctacctcatcttcgttataggcgatgaaccttcacttctgtccccgtttccgcacacgcaccaatccccactggcgatcccttccccttcggcatcacccccaccttcatgcgccccagctccccactcacatccgccccctattgggctggctctagcttgcaagagcagaaggtggcccagggcccagccttccaggatgtcccctggaccccctctctgggaaaggcggcagagctactggccactgacaagacctttgggccctcgtgctagacaggccttcgaatccacctgctccagcccagagagcaggcccaggccgtgcctcccacaccgcagccgacctcagagcaccctgcctcaactgtgagttttttcttggcaatcctctgaaacggaaagggtatcagtcctgactagggcgaacgtgaggtccattctgcatctccatccaccttagctgtctccttggaaaaggacagcaagggagtttgaggtgcactgacacagtcatttctgaacagtgaagagatgacaggtagggtggtcccccttgaaaagtcagccagaagtagctgtatctgatgcactaggtggcagggagtgagtcttggagtaaatgggactgaaaacgtagaaaaaccaaataaatgccaaagagactatccctatggagaatacctagaacatgggtctttgaagtgtggaaaaatgaaagaaatccaatttgaccagggcctttagtgccaaagagatggctagcaggagagtggtgagaaaggagaactggagagttcacatgagcggaaataggaagaaatggatccaaatccaagtgagaaaaagcaggagacttaaagttagcctggcaggatgatgagaaaaggacatcttgtcctagggtagaggcgagggtgcagatctgggggaagaaggcttattgggaacagtttctcaaactagacattcagaagtcaatacaagggccaaaaccaaaatgttcctggaggtacctgtttttgaaagaggtgggaaaggtgacatggattaggggtctccatcccccaggccacaggccagtaccagtctgtggcctgttaggaagcgggagcacaaagcaggaggtgggcggcaggcgagtgagcattaccgcctgagctcctcctcctggcagatcagcagaggcattagattctcacaggagtgcaaaccccactgtgaactccgcatgcaagggatctagattgcacactccttatgagaatctaatgcctgatgatctgagatgaaacagtttcatcccaaaatcatctccccgctgctatccccctccatccactggtggaaaaattgttttccacaaaaccggtccctggtaccaaaaaggttggggactgctgacaaggagtatgagtgtgaaaggtgcagaggtctatgccaggagacagccatccccaatagaagccctcagctatgcacaaactgcttaatgtcattcaaagaaaataatgtcgcccattttgcctcagagctttagccccaatcacagcaactgctatttcctgacgcttacgcaccagagatggtgataagagcactgcacgcattatctcagtaatcctcataacagcccaatgagttggcattactatccccaatttatagatgaggaaacaggctcagagaggtgaagtaatctgaccaggttacatagctaagtggagtcaggatctgaatccaagaagactgtctctacagcccatgctctcaataatccatcctgggctcctccagaacctgtgggaaactcagaggatgccaaatgataaattcctaaaaacctcactccattatatatgggaggaaagagaggacacctctgtgaacctggagtgattcatcccatcagggcacttagagatgctcctctttgaaaggggaaagaaccatccccagatgtggggtgatcccacatctgctgtatgtttgaaggtgataagcaatggacagttcacctctggaatgcctgaggaaaagagaccctccccaccatctctgaggggcagccctatttcttggatacattagggaaaccctgccctaggatctgagggaaacacagtctccactccaggtgcctgctcactctcctggagcttctggccgtcgcaccctattgcagctcctgggtttggctggggcacaggattaaccatccccaggaaatgcctccctccggtccaggcagggatcccagcatacacacccctggtggtggcagtgggggagaaagggggaaggtggaatgcttccttctctccaggtcagggaagagatctggggaccacctgggggccctcgcccctcctgcctccttgctggggaagtgcccagtccagtgccccctccatggccacctccctccctctagctgtgccggggcatgaatcagctctcacagcttgttaaagctagacctcttgttttcatgccctcacctcaggaaacagagttacaacttttccagctctactcagcagggggccagggtcctcactttataaacatccccagcctgtgagagcagagggcagggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaaggtaaagtggggtgaagcgttaggaatggaggagcagcagagagggcacagggaggatggggccttacagatgatcccgtgtcaaaatacccaggcttcctccagctgtgaaacaggaaagacaaactaaatacggggatagtgcgtacttactgtctccaccccagaccagaagagcctctgcctctcatcagcactcctacacctactaacatttcccgttcttccctagccccctgtcactatgaggggaaatattttaccctgggtgagtcttggctccgcaaggactgtttccattgcacctgtctgcatcctgttggcgtgggctgctgtgacacgtgagtgaccaaagatggccagagagaatgactctgatatgagtgactgagggatgaccagggagtgactagattgctgtgatgtaagaatgaacagaagagcaatacaagatgggccaaacctgaagggaccaacactagtgtgaaagataaggcttcaggctataaatcaggggaggttggggtggacctggagagaaaatactcctgttataaaacaaaaaggcccacatatggtaggtgacagcttagttaggaggaccaaggggccactgaaaggggctctgtggggggaaaactgtgagagagggaacatgtgggcagggataaaggcagcctttcactgtgctgactccttcccctatccttggttccccaggtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaagcccgactctcactgtccacgacattggaccccaggtggaaaaagtgggtcccattagagtccaggtgctgagttctcagtatccggaaggaactagcaccagggtgggccagtttcagatggttatggtgctggtgctggggcctggggcagcatatgaggccagggtggggctagtaggcagcaccttgatgggcaggtcccagctgaaggtgtctacaggtacttgctcaggtcctgtccaggtggtaggttcgggctgttccacagggggtaggagtaccaatcctggttctcgggacgttacaaattcaaaatgcaatctccacttcaaggacactatggaagaaaaagattaaggtagaagcatcagaagctagcaggagtaaaagccaatgacaggatatagttagtgaatgagaagaaaacaatctgtgttcaggaagacagggaaaagtcacagggcagggagctgtgattaagggtttttctgaagcaatgggtactaccacagatgtgagctgaagatagcagtattaagtacctaataacctaagagtgaggcagtcaagtctaggtagcatgaagtaatcaaaaatcagtgtatcacagggtcctagtaggtaggtgtggggaaggagttctatcaagctgttaggagtttaggggtcagtgcatctaagaaacaggaagaggttgaaggtctgagaaactgttccgggtcagaggctagacgtgggtatgtctgggagtgtgtataaggaatcaggatccattacaccctcccttagcacagcattttactgtccccctctcccttctccagtaacagtgagggtctcaccaatggctgtacagaagcctggggtggagctgagagggattgggagggagaagctggttctagttgtatgtaggcaggattcctggtgccgggcgtgagtcacatgtgacacagaggggacaccccctgccccacgtcgccgctggtactcaggctgtacacgctcctcggtctgtaagctgactgaaaactgggagcaagagacaggtgtgtgctaacaggaagtgctgtctgtaggtgagaggacagcccaacctcaagctgttttacaaagggaccctggatgaccccactatccccttctacatgccacccctctttatacaggccttccaccctagcccttcaaccccagcaccccagcaggtaagaagctctgctcccttcttacctgcaaacaagctacggttccttcccctaagtttaaggtccccaccacgtcctcgccaagtctgtacacagatttgaagatgccaaacgtcccaactttccctcggccatcactgatattgtatagatctggggagaataggacactataagcctggagtctacatactggataacgtctaggactgggcaccacaggccaaaagatggggcttttctttaaaattggaggtgtcaggtatcagtggatccacagaagtgtgtggtggttaggagactgtctctgagatgggaaaacaatgaggggaaggatggggtaggacaattctgaaagaattctcacggaggctgcggcaggatgtggcagccattaggcgttccccagccagctcagctagccatgaatctttcttcccaccttcatcctcctccaagaatggactggatggggctacagcctcatcctggggaaaccggacatcctgaaggcctagagaaagaatgagtggagaggtaatgctgagagggaacggagatgagagtagaggttagggttttagattctaacatgagatggctaaaggtaaggggtgccagggctgaggtttacatctctatctccagaaccctccctcccttcccaactccctagcactgtcactgagaccaggaagtttccctgcagtccctcttgcaagccctctaagacaatttctgctttggcatcgcccttccccagcccttccctccaggagcccttgcttaccagtcagcacaagaaccctcagagggactctgagtaaagtgataggggagttgacacgctggcagccaatggtcagtttgtagacgtacttgactgactgaccccgaaaggagggtggtccctctatgggcagcacttcactgtaggagtctggttgggaagtagttgtcaggacagccagaggcaccagaggagtcctccctccaggagacttagaaggcaattcagggatggggacaatcactcacatgatttggactctccaggatcaagcctcaggtcacagaatagaattttcggtggagtagaaaggatacactggcccctctcacctgaaaaaggtaaaaatgactaatttaatgacccattgtccagtactgaacaagactagcacggcaagtggagatagtgaaaggctgccaggccctccgtccctgctgtgaaatgggaatagtcttctacccctaaagcaatagtcatgctccccaacatccccagcatgacagggactataagaacaagaacaattaacaacttcacccatgggtgacaatgcctccacacacaccctccgcaccccccctctcccaggcaaatgcccctctctaacctcggtgtggcagaaagacagtctggctgtcgggctggacatctggctgactagagtcaggaggaggcagtgctactcgactctcactggcatggaactggcagtggatttgggcactggcccaggccagggcctcactgtgggaaaaggaaaaggaggcatcagaggtagttcctgacctcacaaatgctttcccaagctccctatcacaccatcttaaccaacaaggttagatggctgtcctagtgatcaggaaatccacaatcccaaagagaaaccattaaataaagagtagcagactgtgcgtaaaaaggggaacgggggaggggaaggaaagcgtacagctatgtcatccacatcttctgttaaagagccctctcctacaatgacagcacagtgagcaagaggaggtggtgtcgctacaggacaacctgagctctgcctcagccccagagataatctggcttcttcccagaagggccaccaccttcagtgccagcatccccacctggatgcagaagtggccgtgggcggaagggggttggtgacggtcactacacactccagcgcctccccagccaaaaatacaggaccccggctgagctctgctaccacttcaatcatggcagctccggaatcagatctagaaggaaacaaggcggggcggaggtcagcaccttgacagggaggggcgttgcggtgagcacctagggctgagggctgaggacaggggtggtcagcaccgtggtgcccgagggagctcctggatataggaggggtaggcgggtgggagggaggcgactgaagactcagtactgcccagggggaggacatcgctctgggccctagaccccagcccctgtgcgacgggttcttctccctgggcacccccgcggagttcccaaactggcctccgctccccctttcctcaaagttccacgtcccagcccaagatcaccgccgctagtcacctcgcatagtcgacactagggatcggcacccctaggcctcatct

SEQ ID NO: 1880 - DNA, 7328 bp, Homo sapiens
aaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 1881 - DNA, 1387 bp, Homo sapiens
  misc_feature (903)..(903): n equals a,t,g, or c
  misc_feature (1320)..(1322): n equals a,t,g, or c
gtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgnacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctcnnnaagtgttagtattataggtgtgagccaccatgcccagcctagaaaatttaaccttatcttttagc

SEQ ID NO: 1882 - DNA, 856 bp, Homo sapiens
agatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataa

SEQ ID NO: 1883 - DNA, 971 bp, Homo sapiens
gaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtgctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccatt

SEQ ID NO: 1884 - DNA, 5365 bp, Homo sapiens
gtccacgtgcggctgcgccagcgcatcatcttgtacgaattaaaggtgcgattagggagcggggtctgcaactgggtagggaccagacaggaccgggctgagataacgcacagggcctaactcggtgatggggcctccggagagatgctaagcagctccttctccaagaaaggcaggtcctggggaatgagaaggttgagaggaggccgagatagggctgcccgagctccaagcgtgtaggaaaaggatgcgccagggctgggatcggtggctaatgcttgtaaccccagcactttgggagaccgagacaggtggatcgcttcagtctaggagttcgagaccagcctgggcaacatagggaggctccctctctaccaaaaaaaaaaaaaaaaagtttgtttttttttaagtaagcacaagaagcgggcggggcctaaggcaatttggttcaaagttaagtgatgggagcggccagcagggcgtcttgatacagctgaactggaacttcaggccaggaataaagcgcagggccacctgggggcggagcctctgatgggcagggctgaccaggggcgggtcttgggatgctgggcggagcctcaggggcggggcctggggtgctgagattgaccgcggagggatgggggcttgggttgctggatccggccgcgaaggggcggggctgtaaagggccgctggtttcctggagcgggtggaaccaggactgcagaggttgttagcgggtggggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatggtgaaaaacagtctctactaaaaatacaaaaattagacgggcgtggtggtgggcgcctgtaatcccagctactcaggaggctgaggcaggagaatcacttgaacccgggaggcagaggttgcagcgagccgagatcgcaccgctgcattctaggctgggcaacagagcgagactctgtctcaaaaaaaaaaaaaaaaagaagaagaagaagaagaggccggggggaggaccttaagcttggctcctccaggaccccaagcctctactcatggtccatcccgctcccaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggtaagacacggaaatcctgctgataccgaatccagggattcaaatcctgactctgttggccaggtgcagtggctcacacctgtaatcccagcactttgggaggccgaggctgaggtcaggagttcgagaccagcctgacaaacatgatgaaaccccgtctgtagtaaaaatacgaatattagcccggcggtagtggcttctgtagtcccagctactcgggaggctgaggcaggagaatggctcgagcctgggaggtggaggttgcagtgagctgagatcgcgccactgcactccagtccgggtgacagagtgagaccctgtctcaaaaaaaaaaaaaaaaaaagaaagaaagaaagaaagaaatcctgattctgtcactgggcctcagcttcatctgtgagatgggttgaatgcgggcgcgttccactgagaagggaactgccacatggtgggtaccgggtcagggcccattctctgccttccccccttcaggaccgtgtttcttcgcctcgcctccctggtggtcctgctcttctctctctggaatcagatcacttgtgggggcgactccgaggctgaggactgcaaaacctgtggctacaattacaaacaacttccggtgagaacggcatgggtgtgcgtgggactcttgggtccctgaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagatctccccgctccccgcccttgttttagtgggttacttccctctggccccgacggcggcgacatctgggtcccttctagtcctcaggacccgccctctggacacaccccctccacgtggagtcctgaaagtcccgcccccccccccccaaccaatacgcatgcttcctattggcgggcggggcggtggaggcggggaaactccaggccgccactcccctgactccggcccggccccgccccgtccttcaggctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaaggtaaggggtaggggggacccttgggtctgaggcaggaggtattggggcccgcactcctgggtcaagggcaaggaagatcctgggggcctggattactcggtcctgagagaggagggggttggaggacagactactgcatctgagaggaggggtctagggcattctgacttatatgtctgaggatctggggactcagactccggggtcctagatgaggaaggggctcagactcctggttcggaaaaaaggagaggcaggtaggccgggtgcagtggctcacgcctgtaatcccagcacttcgggagactaaggcgggtggatcacctgaggtcaggagtttgagaccagcctggctaacatggcaaaaccccgtctctactaaaaatacaaaaaaaattagccgggcttagtggcaggcgcctgtaatcccagctactcaggaggctgaggcaggggaattgcttgaaccagggaggtgaaggtcgaagtgagccaagatcgtgccactgcactccagcctgggcgacagagcgagactccgtctcaaaaagagaaaacaaacaaacaacaacaacagcaaaacaaattagccgggagtggtggtgcacacctgtaatcccagctactcgggaggctgagacacgagaatagcttgaacccgggaggggaggctgcagtgagagccactgcactccagcctgggcgacagagcgagactctgtctcaaaaaaaaaagcctgggcgacagagcgagactctgtctcaaaaaaaaaaaaaaaaaaaatggaggcacagactcttgtgtttcagagcccttttctccgtgccttcccccaccagcttaccctcttctccacctgctccccggctgcccgcaccttccgggcctccgcggcgaatttctttttccccttggtccttctcctgggtctggccatctccagcgttcccctgctttacagcatcttcctgtaagtgcgagaggctcccgcctctctccctccctctctccccattcagtgttcagactcctggcactatgtgagcccagcctgtcttgacttcaggatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccaggtgagacggcccagacttctgggtctgggtttgaatgcgtgtgatctgggggccaccacctgcgtccaagagaggagaggcttgggcgtgggagcaggcaacgtactgagtctgagggaggaggcctaggctcctggactgctgggtccgaaggaggaggtgggcgggacgtaggactcctggatctgaaggcggaggggctgggagactgaactccttgagcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagacagacggtgagccaggcgggtccctgagagggcccctggggaacatggaaaggggttggggaagaggattgtctcacctccacctctctttgccccaggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtcctgactctcgggtgatcttccttgtatcaataaatacagccgaggttgctgagcgcgctttgaaa

SEQ ID NO: 1885 - DNA, 5360 bp, Homo sapiens
gtccacgtgcggctgcgccagcgcatcatcttgtacgaattaaaggtgcgattagggagcggggtctgcaactgggtagggaccagacaggaccgggctgagataacgcacagggcctaactcggtgatggggcctccggagagatgctaagcagctccttctccaagaaaggcaggtcctggggaatgagaaggttgagaggaggccgagatagggctccccgagctccaagcgtgtaggaaaaggatgcgccagggctgggatcggtggctaatgcttgtaaccccagcactttgggagcccgagacaggtggatcgcttcagtctaggagttcgagaccagcctgggcaacataggggggctccctctctcccaaaaaaaaaaaaaaaaagtttgtttttttttaagtaagcacaagaagcgggcggggcctaaggcaatttggttcaaagttaagtgatgggagcggccagcagggcgtcttgatacagctgaactggaacttcaggccaggaataaagcgcagggccacctgggggcggactctgatgggcagggctgaccaggggcgggtcttgggatgctgggcggactcaggggcggggcctggggtgctgagattgaccgcggagggatgggggcttgggttgctggatccggccgcgaaggggcggggctgtaaagggccgctggtttcctggagcaggtggaaccaggactgcagaggttgttagcgggtggggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatggtgaaaaacagtctctactaaaaatacaaaaattagacgggcgtggtggtgggcgcctgtaatcccagctactcaggaggctgaggcaggagaatcacttgaacccgggaggcagaggttgcagcgagccgagatcgcaccgctgcattctaggctgggtaacagagcgagactctgtctcaaaaaaaaaaaaaaagaagaagaagaagaagaggccggggggaggaccttaagcttggctcctccaggaccccaagcctctactcatggtccatcccgctcccaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggtaagacacggaaatcctgctgataccgaatccagggattcaaatcctgactctgttggccaggtgcagtggctcacacctgtaatcccagcactttgggaggccgaggctgaggtcaggagttcgagaccagcctgacaaacatgatgaaaccccgtctgtagtaaaaatacgaatattagcccggcggtagtggcttctgtagtcccagctactcgggaggctgaggcaggagaatggctcgagcctgggaggtggaggttgcagtgagctgagatcgcgccactgcactccagtccgggtgacagagtgagaccctgtctcaaaaaaaaaaaaaaaaaaagaaagaaagaaagaaagaaatcctgattctgtcactgggcctcagcttcatctgtgagatgggttgaatgcgggcgcgttccactgagaagggaactgccacatggtgggtaccgggtcagggcccattctctgccttccccccttcaggaccgtgtttcttcgcctcgcctccctggtggtcctgctcttctctctctggaatcagatcacttgtgggggcgactccgaggctgaggactgcaaaacctgtggctacaattacaaacaacttccggtgagaacggcatgggtgtgcgtgggactcttgggtccctgaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagatctccccgctccccgcccttgttttagtgggttacttccctctggccccgacggcggcgacatctgggtcccttctagtcctcaggacccgccctctggacacaccccctccacgtggagtcctgaaagtcccgcccccccccccccaccaccaatacgcatgcttcctattggcgggcggggcggtggaggcgtggaaatccaggccgccactcccctgactccggcccgccccgccccgtccttcaggctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaaggtaaggggtaggggggacccttgggtctgaggcaggaggtattggggcccgcactcctgggtcaagggcaaggaagatcctgggggcctggattactcggtcctgagagaggagggggttggaggacagactactgcatctgagaggaggggtctagggcattctgacttatatgtctgaggatctggggactcagactccggggtcctagatgaggaaggggctcagactcctggttcggaaaaaaggagaggcaggtaggccgggtgcagtcgtcacgcctgtaatcccagcacttcgggagactaaggcgggtggatcacctgaggtcaggagtttgagaccagcctggctaacatggcaaaaccccgtctctactaaaaatacaaaaaaaattagccgggcttagtggcaggcgcctgtaatcccagctactcaggaggctgaggcaggggaattgcttgaaccagggaggtgaaggtcgaagtgagccaagatcgtgccactgcactccagcctgggcgacagagcgagactccgtctcaaaaagagaaaacaaacaaacaacaacaacagcaaaacaaattagccgggagtggtggtgcacacctgtaatcccagctactcgggaggctgagacacgagaatagcttgaacccgggaggggaggctgcagtgagagccactgcactccagcctgggcgacagagcgagactctgtctcaaaaaaaaaagcctgggcgacagagcgagactctgtctcaaaaaaaaaaaaaaaaaaaaatggaggcacagactcttgtgtttcagagcccttttctccgtgccttcccccaccagcttaccctcttctccacctgctccccggctgcccgcaccttccgggcctccgcggcgaatttctttttccccttggtccttctcctgggtctggccatctccagcgttcccctgctttacagcatcttcctgtaagtgcgagaggctcccgcctctctccctccctctctccccattcagtgttcagactcctggcactatgtgagcccagcctgtcttgacttcaggatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccaggtgagacggcccagacttctgggtctgggtttgaatgcgtgtgatctgggggccaccacctgcgtccaagagaggagaggcttgggcgtgggagcaggcaacgtactgagtctgagggaggaggcctaggctcctggactgctgggtccgaaggaggaggtgggcgggacgtaggactcctggatctgaaggcggaggggctgggagactgaactccttgagcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagagagacggtgagccaggcgggtccctgagagggcccctggggaacatggaaaggggttggggaagaggattgtctcacctccacctctctttgccccaggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaaa

SEQ ID NO: 1886 - DNA, 22001 bp, Homo sapiens
ggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggtaagctcggaagccggcagggcggcgctccggggcccagcgcgcaggcgccgcggttgggggccggaagcggaggcgttgcgcaggctcaatgtgccccgtgtgaaattcgggaccaggcgccgatcccactttcgaggacgttgccccgcaaaccttgtgcccacttccacgaaaccttccttgatctcgccctcgtcttagtttttcccccactgatgtatttcacatggctggaacagtgtctagcacaaaagagaagcttaacatttaatgaatccgtgaacccttggacagttcaaggaaattcggatcactttttagtttgcctgcacagcctatttattgagcatctactgtatgctaactacatgccgtgcacctgacttgcggaatccccaataagcactgttcgttcttagaggggcactgtcatctctgttgcacgaagtgagatggcttcagtgaggggaaggcacattttaaggagaggcggacagccaggctccacgccatcgggcgagccctttcgtgcaccgccccctagacacatacacacaaacacgggctttccgtatggctctttaaatctgtttggtgtacacccaactttcatttccttagctagtctgatcctccgccgtgggtgggaggtagtctaggtttttagaatctcagtaggctgctgagcgctgtttgaaatccgcgtcctgaaggcaggggacagggcttcagcagacttggggtagtcacttggagccatggctagaattcagatcgtctggcctaatgcatacctttatggctgttttaattgtctcacttgaggttaggaacccctttggtttaggccagggacctcctcccatacatccttgatgacccgtggtttactatttgaaagggagtttacaaaacccaggcgttgcctcatctgcctaccctcacccccagctaggacaggtgcctcttttaggcgcctagtgctccctttctcataaccccagcaccctggactgccattttctgtggtgggcaccagactcacagttcttgaattacctctaggttctgaatgtcctgcctataactttctccccaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagtaagctggcctcacccacttcatcagaggggccatgaatcgagttggagggagggggcactttagccattggttgtgaccaaggtcaaacaagagtgaacacacagaatttaggaccataccaaggcatgacactcaaaaagcgttggctattgccgtctgggcgcccacaggggttggaggtagatgctagaggtccccagctgctgggcaaaccgctcagttctccaaactggaggagtctcaaacctgatgggcttttaaaaatttaaatcagccggctgtggctcacgcctgtaatcccaccaccttgggaggctgaggcgggtggatcacctgaggtcaggagttcaagaccagcctggtcaacatggtatctctaaaaatacaaaaaaaattagccgggcatggtggtgcgcgcctgtaatcccagggaagctgaagcaggagaatcgcttgacccaggaggtggaagctgcagtaagccgagattgcgccactgcactccagcctgggtgacagagcgagaccccatctcaaaacaatcaaacaaaaagtgaatcaatcgcctcttgctttttggctaagatcaagtgtaaaaggtacatcagtggctgtgcatggtggctcacgcctgtaatcccagcactttgggaggccaacgtgggtggatcacctgaggtcagaagttcaagaccagcctggccaaacatggcaaaaccccgtctctactaaaaatacaaaaattagctgggcatggtggtgtgtgcctgtaatcccagctactcggggggctgaggtaggaggattgcttgaacctgggaagcagaggttgcagtgagccgagatcgtgccactgcactcgagtctgggcaacagagcgagactccatctcaaaaaaaagaggtacatcagctcttgtcatttatctgctgtctctggacttgctgaccccacccatcgctcctctgctttgcttgatcccttcaggcttctcttcaagtctctctgcaaagatgcctgcctctgaacactcaagtggctccacttgtcccctccttcccctgctgttactgtacctgctactgtccccccagggggagctttgcctctgtttgtcttccatccccagcacctggtccaactggttcataacaagccttagatacctgttcgcttagatacctgtgtcagggagacacacctgacaccttgaaagattatatcacatctcttgtatttcctggccccctcaggagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagtaagaagaccccacctcggcagaccagggcccagaccttcagggcttggcagcagcccagcatgggcactgcagcgtctctggtcaggacagccagggactccgtgaagggctggctaggtggagaagtggttctcagcatgtggtccagggagccctaggggtcctgacaccctttcccggggtgctgtggtgtcaagcctattttcctgacactggtggacttttccactcgtgttctcaggcatgtagtgcaggtttccagaggctgtgtgatggggagacaccctcactctgatggccaatggcagatgcttgtgtccaaactttcttagttttcactaatgatttgcagcatattaagagaacccatttaaacaaaagctcttggggtccttggtttttaagagtataaaggggtcctgagaccaaagagtttgagagctgctgggttagagagtaaaagcaggcttctgtctccaggatgctgcacccctggtctagagggggtacactgcctgtagtcttctttcctctagaaagggaaactgagggccagggggctgctaagtgtgctttcttgacctggagaagcatcagattttaaagactggggaggaccaaagcccacagaagggaaggccagagacgtgcccatggcgtcccagcaccaagtggctgcttccagcaggcctaaggagctgaggctggggtgtgctggatgcagcggggcttccaggcggcagctccctctatgggagaggttgggggaatggcctcctaggggctaccagctttctgacctcactcctctccccacaggcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgggcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcctcacaaggttcttcttgggtaggaaatgttatcatgccacttcagcgaggaggaaacggagggggccgcagaggttccaccgaagccagctgccagaacggggccccagccccaggtgtgagtgcacagccttcgtttcctcgagggctgtggcttttgagcacctctcacgtgagtacaggatgcacagcctagcatttaatcttcacaaagacctcgaggcagtgggtactgtcacccttgttctagagaatggaacagtctcagagtctaaatccaagcactctgcagggacattttattggtgacggaagtggtgtgggaatttctgaatgactggatgccctgaaatgtactaacttggaggatggttttgggccaaaccaggaaaggacaggaagtctgtggttaacatctgaggacacaatgggagaggacctaggttctaaatgaatgtcttaagtgcttcaaagatggcaacctgggagaaccaggagaggggactgagttctctgaggacaaggaccttgtactacttcatccccatgaaggggctcggcatcagggaagtatttggtggaaaaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggcccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagagaagctttgagaaggaagaaaaactaatgtgtgatgagagctgagagaggaggcaatttagaaaatttcccaagtggggatgagggtggaggtcactcatgactcactggggttgggagggggctggacagctccccagtggtctccagggaggcctgagaatgtgccgatgagcagagtggggtcggcctagactggggctgctggagcagggctggggaggggccgcgggtgagccagtgggcaactggaagcggggctgaggtgtgcctcagtggaccagcctcgctgtcaacccaagcagttctaacatctctgggctggaaggcggggacggggacaggtggatttggggcaggggcccaggagtgggaatagggagggggtgcggtcccagtggccgcagtggggcacccacctcacccctccagcccgaggggggacggcggcggtggcggcgaagccggggggcccgaggctgccccgggggccctgctgtacctccagatagtagaagatgaagaagagtgtctcggtcgacaggcgctggtagaattccacagtgtccgagtgtgggggtggcatctggtggtggtaggggggcgtcggacaggggttccgggggaggtactgcctgtgagagcaacaggaaggtcagtgccagctgcctactagtcctgtcgtgatcaaaagggtgctcagacatgcatccctgcggggggaggtggtacagaaagacccagggcggtgctgaccttcagtggagagcccaagtcaggggcctggtgctctacccacagcctcacaggttcagccactgcctcctccgtaagactcaagtcccagaccatcccccttccctgtggcccctcaccgaatacgctcagagtcagaggggtgaggcatgtggtgccaggcggcctcttccatggcctgctgatagagctgctccttggtgaggggcacagggcccagtggacagacacccagcgacagcggtatgttcacctctgacagctgcaggggcggctgggctgaggccggaggtgctgatgtactgctcaggatgatgtctgtggggagggtgggggtccggccccctcagtggtgaggatgggtcaggggcagcccctcctctttggcccgctgcttccccaccatcctgggtccctcacctcgctcggtcaggtgcagcgttggcacagggtcctcaatgccagagctgatggctgcccgttccgccatggacttcaaggagctcagaggctcaggggcctggggaggaaacaagaggcctggcctgagcacttgggctgcaggagcaagtgcagcctgacacaggccccagatgctctcacctgccctgtttgggggccgtggagggccaacgacccactccccacaatctacccatgacaggtaaaagcatcaaactgtagggaaacaatcggagaccacgacgcattcatcagcagaggaacgtctcgtgagtgggactctgcagcatggaatactacgccgagattttcaaaatacaagttcgtgacatactacagaagtaaacgccaacctgcagaatatgtacagtgcgctaccatttttgtcaaaggatgtgccaatagtacacgctccttcactagggacacctacacgctgggagagctcccgcctgtcttgaaggaggcaggaggtctacatgctcagctgtctgcctgtgactggcatggggtgactggaatcggggtgggcccagcccggctaggcttcagtctccttgctggaaacaggtaggttgggtctccagccccgcagccacagcctcgtttcctattacaaaggttacagcaggcttctgttccccaaagtcagggctggttcctcccatctcctccagccacgtgcagctgtcccaaaccccagccctgtgctggactctccacaacgagtcagtcgccaaggcttatccattctgtctcgctatatcgcccaggcaggtctcaaactcctgggctcaagctatcctcccgcctctgcctccctaagagctgggattacaggtgtgagccaccacgcccagctatccgtcctgcttctaaaccccactggatggctcccttccctgtcgtgccaccatgtcccacacagcccaggcctgtcctctcctgcccagaccaccctccctctatcctgtcctcaccagccccaggggacctttccaatgaagtcatgttgttccttctctactccaaaccttgccatggttcccgaccacccaccccagcgattcatttttgttgttggtggtgttaaaagatatggaccccttctgaaaatctcaaagctgctgtttccctttttccagaaaaatgcacgcactataaatatcctgtccacctacttctaaaatttgggccgggcacggtggctcacacctgtaatcccagcactttgggaggtcgaggtgggtggatcacctgaggttcggagttcaagacctgcctgaccaacatggcaaaaccccatctctattaaaaatataaaaattagcctggcgtggtggcaggcgcctgtaatcccagctactcagtaggctgcggcaggagaatcgcttgaacccaggaggcggatgttgcattcagctgagattgcaccactgcactccagcctgggtgacagagcaagactctgtctcaaaaaagaaaaaaaaaaaaaattaatgcttctgttgggccagaaactgttccaagagctttatgaggatgatttagtcttccaaataaccctacatagtaggtataatcgtgactattgccgtttcccagatgaaggcacagaaaggacaatgccaagacttggacctggacagcctgggcgcgcacactgcctcctggacagcctgggcgcgcacactgcctcctggacagcctgggcatacacactggtccccccatggaagctgcgctacagtatactggctcacaagccaagccccagctcctgaccctcgatgatcaggaccccaccgtcctatcctgctacacccactatctcagccctgcagctggtggcactgtctcctgcagagtggacacctctctcctctctgctgcatcctgcccagcttcctaagcacacaggcagatgcatgctcctcctaaagcacctcctgaagcccttcctgcagctgttagcccccctgcctggtccaggtctcagcttaaacatcaccccctctcagaccttcctgggcctgtctcccaggtcaggtcagatgcccctcggtgggcccaccgcaaccttccctgcagctgccccagcagggaagcttcctaaagggtggaaccaggctgcattcacccaaccagtctttctacttgtgcagaaagtacaccagtctatgccttgtgaggacaaacggggacagaaactgagggcctgcgggggggatgaagatggagacccagagagagcaagcaacaagtgcaaccaagagaaaggaaaagagacccagagaaacagagctttggagggaacaagagaggaggtatgagagcccccagagatcaaggtcacggggagggtggtacagaaagacctggagaaagagcaagtgtgagaaggggacagaaagccagagaaagagatccagaaagagggtgggggcagggggtgcagctagagacctggaggaaagaaacaacagagtcaggacacagaggctcgggggatgtccgaggagcccaccttgatttctggggcggtgctgaactgtggaggcccattgagcagggcaccggctgccttggcatcactgaagctgggcgttggggagctgggaggattcacaggcagtggcaccaggaggctgggtccccctgagttgttccctgagcctggggccacgcccccagcccccgttggggctgccgcactgggttccttcctggagagagagcatggaagagggggttgagaggagggtccctgagggtgggatgggcagagaggcctggctggagagaggggagactgcacagatcagatgggatctgagaggggcaggtgagggcagacagatgggagaaagaagtggttctctgggcaaacaaaggcagagcccaatctttggaatggtttctcatcagcagagcagagctgtgggggtgggggtgaggattctcgggtgctccaccaggccacaggctgatcaaaaccacttgccctgggcaggtgttcacagggcccactcccccttgggcaggccagctggagctggggtgagggggcaggaagcaggcctttcctttgtgcacactgatctttcttagggcattcttcgggaaacaggcagacccagtggaatggtctgagctaagatttgaaggagtggctgcagaggaataaggacttcgggacaattcactttgaaaagtgaaacagtgaccctccggtggcagtcaattggcctcaggcaggtaacagaaatggggaggaaagggtatggggctcttgagaaaacttccacttagatgagaacgtattttagaatgttctgaagggcaaagcagggaggctgatgtagtttccttgctggaaagaagtgggggtgtaacacccgagggagatggaggatagcgcttggccattcccagcagcaagggcggggggttcagaacccaccgatgcgggggtgaggcgcctgcgcctctctgtttcaaaaggctgccatcccaaccctgccgatggccgagacactcacgaggtgctgggaggtgggttgtgggggccggaaggggggcccaaggcctggctgctggcattgttgcccccactgctgctcaaagccacctctgccgggctgtctgccacaactgagctgtaacctgggaacaaagagtaaatggaaagggctgctgcctgctgcccagccccgcccacgccccccaccccgctgcctcctcactcactggtggcgccattctgcttgccagcccctccaccggcactgctgttactactgctgctgctccctccacctccgctgccgccgcctccgcctccgctaggctggacgctggggggccggggctgggtcgtgctgggcccactgggagctggtggggccacagcctgggcatagggagcaggggtgcccgagttgtggctgggagctggactggccttggggcccagggcacttgggggtgctgcgggggcggggaccccattgttgccaggagtggtgctcaaggcagaggcagcaggcggggggccggaggggtaggtgggcggcacagctggggactgagggtgctggttgctgtggacaggcttggagccgtttttggctggagactgcgggtgggagagagcagagggtcaggacccagtgggccagctggtctccctcaccacccccacctcaggctccatctttgtcccagcagcctcctctctggcctcgctgcccccacctgctcctgccctcttggggacctgggtgaccttactcaccctcatggcttcaatcaccttcatgcttaaaacactcacactgatttccagcctgcccagcttcccaagtcctgcctggacaccgccccatggacacccccacagggatctgacacacaacttaggttgtcagccagagaagatccatctgttggaagccagaggactagtgggaaacacttaagtgttctcaatatgagattagctggagccgcctaatgtccaagagtagaaggaaaaacagctggaaattggatagtaattctgaatgtcacctgaagggtcacagaagctactcacagggctggaagttaccagcactccagaaagtggtgggagggtaaatgtgctcatggtatccctaccgcaggcaatctgtggacagcactccggctgctgagcctaaccacctcctgggcttctttccagccaccccacaggcaccttgcgcttaccaagcgcccaacaggactgactacccacttctctcctgggcatcgctgcttggcagtgggggcctgggaaggtggcagagcccagcctggcccctggagtacctgcctcagtgtctctcctcatcacctcctggccctgttgcccgccctcactactacctgcgggtccccttagtctccacaccagcctcctcaatgcccactcagggtgtccccttggaaccatccatcccgttagcccacagaggggcctcaggcccatgctgctcctgcctaacattgttctgtagcagcgtttccgaaagcgtgctcctgtcctgggagatgttaaaggagttgaagaagcactgcccgccaccgtctcctctcagaaatttgcagtgtgtattatcagcacagcaaaggccccatcgcttcctaggcttattggactctggaggccactcaggtccacaaagcctgagcccctcagcctgacagtcccagtccctgtgctcacagttgggcccctggccctgcagacctggccagactcatctctcctcacttccaaactttctgtcacaacttgcccatgttactggctgccacctctccctgccaggcaaactcacctgactgtgaagcccagggcactccacagcagcatctcctgactgcctggccaggccaagggtgacctgtgtgctacccccttgaccacagcaccagtcacctgtccacttgccctgcccacctgccctcagggcagcactgatttctgagccacctgtgtccaccagcccagcacagtggccggcgctcaggcctcaagatgcctttgggaagcaacagaggagtgaatggcgtgcccacccggtccaggctcacacccacctggctgacttcactgtctgtggaacgtcccctcttcttatcatcttcagagttttcctgaggtaggggaggcagaatagaaacctgtgtgacctctggggctctgatggagaaccgccaatctctgaatgccccggggacctgggcccaattgactgccattgcggccccagagctggtcaaatggctgtccttaatctgcctggagaaaccatctcaattcaggctctccagtcttcttgttttctgggagccagcactgacccaccagcctcttaaggatctgggaacctgctctccacagggaagccaacccttggatccctgcccaaggtggccagctacccagcctcctcaggcagcccaggcaccggcccctcccacttcccagatccaggacctaaactggcgcgggatgcaccctattgctctttatgtcctttagggacccagatataggaccttagcgtgtgctccaagagcctagaccctggatacctagatctgtgtttcctcaattacgctcccatagccactttggagtgacccagatttgtctcctcgagtcctgccctgctggaaacacaaggtactagtgtcccgtggggcctcaccgtggtacagttggctgggctgggcgggatgggagagctggaggtggttgaggtgggcgtgctgctggactggttgaagatctcatcctccatgtggctgtggctgggaggggaggtggcgaccagcgcctgtgctgtgggggcagaagaagggcatgcttagctggctcacacagcccattctgggccctcacttcctgtgccacgatcagccccagggcctcacgaatgtcctcgaggtccaggtcatcgtagagaaactcgttctcctcgaagtcggggtcctgggatgagtcaacatagtactcaacgtcgtccttgatcttgcggatggcgtcaacgaggatggagtcattgtccagcatgcgcaggatggtctctagcatgcgcacgtggtagcggtgcttctcgatgtgccgcttcaagccctcaatccggtcctgcttctgctggcgagcccagggccaggctcaggggctgcagagcacctgcttggcccctcctgcccccacagaacctgtcctcagtccctgacccctgtggagacccaaagcctccacgccatccccttcggggtggggcagtatggggtccacccaccctctgagccctgtggggaccaatcttagccttgacatcttgggatcccactgctccctcctctccccacacctttctggctccaggagtccttggaaacctctaaaagacccagaggtccttgtgccatcccacgacttggcctccatctgcacctcacctgacagcccagatttctcaactgagcccgcccaccactgtgactgcctctggcatacagataccctccgacctgctccagcagtaacaatgataacccccatttgtgaggagcttgctgtttagaattgtgatatctgtcatcactaggcccccaaccctacccatttatccctgagagagcccagattcctaagcctcgctcctgccctcccctcaaggcccctttaggatttaacatcttagccttggttccaaatctctgctctgttcaaggacccatcatctccccgaaagcccctggttcccaaacccctcagagtctgacacccaaccctgtcatcttccacttcctgaccctctcccacccacagcttccctgaggacccggctctcccctccctgtctttctggtttcagcaagtctgtacagtttgtatccctttgaactcataccccacaatcccggattttagaacctgggaccccaacatccagctttgtcccagactcctgtcttccttcaggcctggttctctgccttctccatgttctgccttgtctctacccactgtgctctccctaggaccagggccctctgggtgccaggaggcctcttgccatgggtgtccttcaggtctcacttttactctgtggcccaagctcaacctgcactcaccttcccccaagtcgctcctcttcacaaaggccccacggtctacccagacacccaggggagcctgagattctgtctgacctccttcctgccccacgcgtgcagctgctaagccctcccaatcctgtctctcaaatccctaatcccggctgttggccctgtccgcctgaggaatccaggccccaactcccaggagcataaatgactggcctcctgctggccagcccattcccatgcccatccccatcccaaaggtgtcgggtctccctcactcacatccttgtcgcccttcttcttgcgtgtctgcactgacagtgactccacttcactctcaaactggtccacctgcatgttgagcgtgtcgatggtattctaggggagggagaggaagaggaagcccatcagctagggttccgcctacacccagggctcaggatcctcagagttcacctcctcttctctaccccaactcaccgtgagccactggccaacctcttccttctccttctgggcaggatctaccttctgggccaggcccaggccctctttgctgtaagctttggttttggtctctcgttccacaactttgaaccgttccatttgctgtagagagtgcagttggcaggggggctctcaaaggtgggaaaggagctgactaagggccagcagacactccgacctgagcctcgtgaccctactttctgagctctgagtccgctgcctcttcacttcccttaggtgcagaaaccttacttctcttgaggacctctggggtctggccgctctgcctccgccccttgggatctcaagaatctggtgaccttcccacctctctgggactcaggctctgggctcctaccgtctcaatgagcttgcggttgtctataagctgcctcttgtccttgatctcgttggacgctacccatgtcttgatttggtccctcagccgctgcagatgggaaaagcaagaaagtcagacctcaggacccaggaactggggcccacagctccttctccctgggacccagcagtccactctcccagttccctctaccctcaggacaaaggcgtccaggcccccagccccctcacttgtagcttcttaatctccttctttaggtcagcctcatacttttctttctggttcgcgttggctgcattgtggagctgagggatggagagaattgagaagtcagtgtgggaggggatgtcccagtacccactccagtgattcttccttatgctagggactcgaggaccccccccaacccctacccccaatccatcttagagctgattctcttaggtcctcagcatctgcatatgtagcccctcccgctggtcaacacccagaggtcctgagccgccttcctgtgccctcctctctgaagacccagattattagggtctcagcccctgtaccttctgccaaatatcttcaaactgctccacgccctcggacaccttcttgaggcagcgatcaatctcacctggccagggaggaacaaggctgtgagaatcctgcccaggtggcaggtatctaaagagcagtcctcagaagagggagcatgtggctacaggtgcagcaggaagtcagtctagtaccttggagtttgcgcttgtccgccatcttccctgccctacagacgcactctcttcatactctcttggagacggacgctgctaggagagattggagaggaattaacacgtattccctggctggtaaaaacccagagacatggacctagtcagcatagtgaggtaggtgggactggtaaagagaagaagcatttgctatctgacaagagaccagccccagttctcctgatgctcgcttgactgcccagcatagtgtctggccaacaggggaccccataagtttgttgaaacaagaaaagttacatacttttttgtgtgcctctgactcaggaagtggaaaattcctagagcatggagtaccttctccccagaatacactcaaaaaggtttttcagagcaggacagtcatgctgcacacagctgatgactgggatggaggcattagccctggaaatcacacttcctactcagaggggctgggcagaggtggctaggagaggtcatccctcagacaagtcaggagacaaatgaaactggcagctcacagagaagggcgtgtgtgtgtgtgtgtgtgtgtgtgtgtgtgtgtgtgtaagctgtaggtaggagaagaaagattgggggtgggggaaaacgacggcgagcagagatgccgaaagctgtgaagagctgaacccgctcatgcagacagggctgaatgccaagtagaagggactcaaaccaccaagacatttattccagagcaggatccttaaaccaaaaggaaataacactcctaacccaaagaagctaataccaagaaggcttagagatttgggggcagaaggcagtacccaagagagacctgggagaagacagaaatcttactaagataagagggtgcaaaggtaccgcagctgtgagggagccgatctgcactcatggaggaatcccatagcaagtggattggtaatttagagtcagggagacatagaccatcagggcaggaacccaaaacttcaagagaggagcgtctttattttaaaggaagttacctggaacccagagaagactgaggtcaaaagggagttccaaggagctttagtccaagggaagacataccttagggcctgacagcgagaccaggggagccctgggaagagaggcttatgcctcagaagaagacttctgagataccagcggagattgccctcttcccctccagggagggggcctacaatgaaaagcacagttccctgggatccacgggccgctcccactctacgtgtgcagggcagggaaccctggagtagtcacttactgtaaagacagaaacagccccatactgaggaacaagagcctcaatacagagggaagtcacaccaaaagagtcctcacccacaaagaagggaacatctggcaaacagtgctatccaacagaactttgcaatgctggaaacactctatttgcgcatatctgttggccactgaacatctgaaatgtggcaagtgtaatggaggaactgaatttttcatttttaactagttactaatcaccacatgtgactagcagcaaccatatgggacggatatgctttagaacaagaagcccataaaggacagggctggtaccttacccccagggagaattttcccaacaccgcagggacccattctgggtgataataggtaggggtgctaccttacacttgagggaatttaaatctcctcagtaaaaggcccaacctaaagaaagccgcagcagcccccgcccaggtcagctatcacgccctacctggggaatctctaagaaggcaaagcaaccaacaaaaggacccaggagaaggtgccacagtggggattcaggctgaggaggggaaagcccctttgacccagggagctcacacaaggcaagggcctggacaccagagctcaggtgtgcagggatcctcaccaaagtccaacaccccaacacagaaaagcctcttactgcatagggggaacaagaatgtgaaacgagagtttacactccctctttccatcccaagaacccaacagagggtcatgggcaggtgctccagcccagagagagaagaggtctcatggtctacacccctaaacaaggcaatcaacaccttaggcaggtgacgccctccctgtgtctccacacggaaaggactggtatcctagtgcagaggaagaatacccacagagaggagaccacactgtggcagcaagagaaggaagtcctggaggggtcacaagccagaaggaggggaacaagagcgctaacccagggaggtgatgtttcagacagaacagtgtgacatcgaagtcggctacagctgagacccagtgaggaggcagctcctccacagagaaggggcaagtgccagaggcccagggtacttgtcccctagagaggctggagccttagccacagtagagacaacaccttccccgctaagaaaatccttatatcatgagggtatctgtacctctggtccccccagcaaaggaccagagagaagggaagctggagcctgagtctcgaagcagagacgccgccagagaagaaagagccccatttgctgtagtcaggggggcatccaccaagatcctccaaggaaggtggtgatcgcaggtccactctcaggcgtgaagaacctgtgctccagcagcaaaggctctccaagagcactgaggaatctgggaacctcggcccaggaggagacttacccaagaggaacacacatccccacagggaagggacccacaaggcgggtggcggggcggggggaggtgagcaggacaccagcctcacaggagccaacacgctaaaatcagagccaaaaccagtaaagaagagccccccagacttcatctcagggaagatgataccaccacacaaagactcgaggagggaggggcaggaggtcagccctgggaaactaacaccgggtggtccttaaccttgggggccgtcatgtgcccacagagtggtctttgtcatgaggcacctttgatctgggagagcttccgcctctgcagcaaggagctctgagaagtgatgttgaagggtgatccttaacccaggtggctgctgacgtggccacacagaggctctgagactccagaagaaggatgcgttagggcctggggtagaggtagtcatctccactgagatgccccatgccaagggtggggggctggaatctcccaccttggaaagtctacaccagagaagtctctggtcccagggacagggtctacagtggagtctcccgcttgagactcaggtatcttacatccacacagccaggaaactatgccttaccccatacagtgacaaatcaagagggggttttggaagcatgagccgggggcacctgcatccgagaggggtcctcagccttacggtggggacacatgcagaggcgtggacacctcaaatccagaaaagcagccataccaataccaaggatggcaagaaccttatccctgggggaggtgacaccaagaaagggtccttaccctggagagaaggcacagccccagagggaagagcccccacctcgcagtacaggaacccgggtctaggaagcttcctactctcatggggtaccagcagcggggccagaaggcgaaacccttgttctccaactgctgacacccagcgtaagggtagatgggaagtcaacaaacccacagtgtgggatctgatgcaaatatcaagggcagtgggcttcttggtccttggagagctgacaccctaaaggaggagactggtgtgaagatggaagaagcctcatactcaggcaggggtgaagggagggaggggagacatcaaaacccctcaccaaaaggacaggagagctcaccccggggtgggtggccgccctgcactgagaggcagggactgctcagaaagaggggctggtgctgcccgcagtgggagctcactaacatggacagcgtggcggcttagtgtctttcaccaggcacctgagcgccaggggatcccagcagcccccagcaacaagaccacagtggtcctgatatcactgggagacgcccacacccagaaggtcggagagtcacgatgcaggggagttcaaggctgcaaagccaggggcagacgccaggatcaaagaagtgtgagagctgagaccagacgtgggccacactgaggacggtcctgtaccccaggtgggggaaagccaaactcccccaaaaaggcaggcgcccagtgcagcgggatggcgaggctggagccacccagggcgctactcgctatgagagggaagagctgcagactacagaggtggaaacttcggcaaaggctccaactaacggggagtttctcctccactcctctcccaagaggctcccatccgatacagacgggcagctggaactgagatccaggggcgaggctgccgcgtcccgggacgccagtgaggagggatgcggaggcgcctcggtcctgggaagggtgactcccccacccagctggggtcctcgtcccgaccaccaccccccctccccgccaccgtcgagggagaagccccggcgcggagctgccccacaacgcgaaggaccgaggccgaggggggcaggcacctgagccccgagagggcgggcacctgggaccaggggcgcctccatccttccagccaggagccataccgacgcggagaggggcgggcacctcgcgcccgggaggcttcgcaccctcacacccctaccggggggcccgacgcgatgccacgcggggaggcggcggcgggcggggcccggggctccgggctcgcggaaggacccccgggaggcgctgaggaacgtgaaagaggcgcaggaacgggagggcgagagggagggagccgccccccgccgggagccccgcgctgcagaggcggcggcagggggcaggcgaggggaggccatgtcgcgacagacggcggtgtcgccagggcgggaggcggcggggagggcggacgatggcgccggggggaggaagggaaggggtccggcccagtcgagcctgacgctctcaccacaggagctggcgccgccgctgaggagcgtatcgcgacaggcgggggaggcgagcgcccgccgcctttttctcgcgccccgggcccgggcgctatcgcgatagcggcgcgtatgtcggatagtgggtttgtttgattgggcccggggttgttctgacgacgggggtcggggctcaagggaggccgcggcgtctgccgatggctccgcggaagctgaccgggccc

SEQ ID NO: 1887 - DNA, 13994 bp, Homo sapiens
  misc_feature (156)..(156): n equals a,t,g, or c
  misc_feature (10132)..(10132): n equals a,t,g, or c
  misc_feature (11830)..(11830): n equals a,t,g, or c
ggaagtgcaaagaggcgggcgtgccagtccctggacagctacgacgccatgaatatcttgcccaagaagagctggcacgtccggaacaaggacaatgtcgcccgcgtgcgacgtgacgaggcccaggcccgggaggaggagaaggagcgtgagatngggtgctgctggctcagcaagaggtaagctcggaagccggcaggcggcgctccggggcccagcgcgcaggcggcggttgggggccggaagcggaggctttgcgcaggctcaatgtgccccgtgtgaaattcgggaccaggcgccgatcccactttcgaggacgttgccccgcaaaccttgtgcccacttccacgaaaccttccttgatctcgccctcgtcttagtttttcccacactgatgtatttcacatggctggaacagtgtctagcacaagagagaagcttaacatttaatgaatccgtgaccccttagacagttcaaggaaattcggatcactttttagtttgcctgcacagcctatttattgagcatctactgtatgctaactacatgccgtgcacctgacttgcggaatccccaataagcactgttcgttcttagaggggcactgtcatctctgttgcacgaagtgagatggcttcagtgaggggaaggcacattttaaggagaggcggacagccagctccacgccatcggggagccctttcgtgcaccgccccctagacacatacacacaaacacgggctttccgtatggctctttaaatctgtttggtgtacacccaactttcatttccttagctagtctgatcctccgccgtgggtgggaggtagtctaggtttttagaatctcagtaggctgctgagcgctgtttgaaatccgcgtcctgaaggcaggggacagggcttcagcagacttggggtagtcacttggagccatggctagaattcagatcgtctggcctaatgcatacctttatggctgttttaattgtctcacttgaggttaggaacccctttggtttaggccagggacctcctcccatacatccttgatgacccgtggtttactatttgaaagggagtttacaaaacccaggcgttgcctcatctgcctaccctcacccccagctaggacaggtgcctcttttaggcgcctagtgctccctttctcataaccccagcaccctggactgccattttctgtggtgggcaccagactcacagttcttgaattacctctaggttctgaatgtcctgcctataactttctccccaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagtaagctggcctcacccacttcatcagaggggccatgaatcgagttggagggagggggcactttagccattggttgtgaccaaggtcaaacaagagtgaacacacagaatttaggaccataccaaggcatgacactcaaaaagcgttggctattgccgtctgggcgcccacaggggttggaggtagatgctagaggtccccagctgctgggcaaaccgctcagttctccaaactggaggagtctcaaacctgatgggcttttaaaaatttaaatcagccggctgtggctcacgcctgtaatcccaccaccttgggaggctgaggcgggtggatcacctgaggtcaggagttcaagaccagcctggtcaacatggtatctctaaaaatacaaaaaaaattagccgggcatggtggtgcgcgcctgtaatcccagggaggctgaagcaggagaatcgcttgacccaggaggtggaagctgcagtaagccgagattgcgccactgcactccagcctgggtgacagagcgagaccccatctcaaaacaatcaaacaaaaagtgaatcaatcgcctcttgctttttggctaagatcaagtgtaaaaggtacatcagtggctgtgcatggtggctcacgcctgtaatcccagcactttgggaggccaacgtgggtggatcacctgaggtcagaagttcaagaccagcctggccaaacatggcaaaaccccgtctctactaaaaatacaaaaattagctgggcatggtggtgtgtgcctgtaatcccagctactcggggggctgaggtaggaggattgcttgaacctgggaagcagaggttgcagtgagccgagatcgtgccactgcactcgagtctgggcaacagagcgagactccatctcaaaaaaaagaggtacatcagctcttgtcatttatctgctgtctctggacttgctgaccccacccatcgctcctctgctttgcttgatcccttcaggcttctcttcaagtctctctgcaaagatgcctgcctctgaacactcaagtggctccacttgtcccctccttcccctgctgttactgtacctgctactgtcccccagggggagctttgcctctgtttgtcttccatccccagcacctggtccaactggttcataacaagccttagatacctgttcgcttagatacctgtgtcagggagacacacctgacaccttgaaagattatatcacatctcttgtatttcctggccccctcaggagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagtaagaagaccccacctcggcagaccagggcccagaccttcagggcttggcagcagccagcatgggcactgcagcgtctctggtcaggacagccagggactccgtgaagggctggctaggtggagaagtggttctcagcatgtggtccagggagccctaggggtcctgacaccctttcccggggtgctgtggtgtcaagcctattttcctgacactggtggacttttccactcgtgttctcaggcatgtagtgcaggtttccagaggctgtgtgatggggagacaccctcactctgatggccaatggcagatgcttgtgtccaaactttcttagttttcactaatgatttgcagcatattaagagaacccatttaaacaaaagctcttggggtccttggtttttaagagtataaaggggtcctgagaccaaagagtttgagagctgctgggttagagagtaaaagcaggcttctgtctccaggatgctgcacccctggtctagagggggtacactgcctgtagtcttctttcctctagaaagggaaactgagggccagggggctgctaagtgtgctttcttgacctggagaagcatcagattttaaagactggggaggaccaaagcccacagaagggaaggccagagacgtgcccatggcgtcccagcaccaagtggctgcttccagcaggcctaaggagctgaggctggggtgtgctggatgcagcggggcttccaggcggcagctccctctatgggagaggttgggggaatggcctcctaggggctaccagctttctgacctcactcctctccccacaggcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgagcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcctcacaaggttcttcttgggtaggaaatgttatcatgccacttcagcgaggaggaaacggagggggccgcagaggttccaccgaagccagctgccagaatcgtccccagccccaggtgtgagtgcacagccttcgtttcctcgagggctgtggcttttgagcacctctcacgtgagtacaggatgcacagcctagcatttaatcttcacaaagacctcgaggcagtgggtactgtcacccttgttctagagaatggaacagtctcagagtctaaatccaagcactctgcagggacattttattggtgacgaagtggtgtgggaatttctgaatgactggatgccctgaaatgtactaacttggaggatggttttgggccaaaccaggaaaggacaggaagtctgtggttaacatctgaggacacaatgggagaggacctaggttctaaatgaatgtcttaagtgcttcaaagatggcaacctgggagaaccaggagaggggactgagttctctgaggacaaggaccttgtactacttcatccccatgaaggggctcggcatcagggaagtatttggtggaaaaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagagaagctttgagaaggaagaaaaactaatgtgtgatgagagctgagagaggaggcatttagaaaattcccaagtgggaatgagggtggaggtcactcatgactcactgggggttgggagggggctggacaggctccccagtggtctccagggaggcctgagaatgtgccaatgagcagagtggggtcggcctagactggggctgctggagcagggctggggaggagccgcgggtgagccagtgggcaactggaagcggggctgaggtgtgcctcagtagaccagcctcgctgtcaacccaagcagttctaacatctctgggctggaaggcggggacggggacaggtggatttgggacagggcccagggagtgggaatagggagggggtgcggtcccagtgccgcagtgggggacccacctcacccctccagcccgaggggggacggcggcggtggcggcgaagccgggggcccgaggctgccccgggggccctgctgtacctccagatagtagaagatgaagaagagtgtctcggtcgacaggcgctggtagaattccacagtgtccgagtgtgggggtggcatctggtggtggtaggggggcgtcggacaggggttccgggggaggtactgcctgtgagagcaacaggaaggtcagtgccagctgcctactagtcctgtcgtgatcaaaagggtgctcagacatgcatccctgcggggggaggtggtacagaaagacccagggcggtgctgaccttcagtggagagcccaagtcaggggcctggtgctctacccacagcctcacaggttcagccactgcctcctccgtaagactcaagtcccagaccatcccccttccctgtggcccctcaccgaatacgctcagagtcagaggggtgaggcatgtggtgccaggcggcctcttccatggcctgctgatagagctgctccttggtgagggcacagggcccagtggacagacacccagcgacagcggtatgttcacctctgacagctgcaggggcggctgggctgaggccggaggtgctgatgtactgctcaggatgatgtctgtggggagggtgggggtccggccccctcagtggtgaggatgggtcaggggcagcccctcctctttggcccgctgcttccccaccatcctgggtccctcacctcgctcggtcaggtgcagcgttggcacagggtcctcaatgccagagctgatggctgcccgttccgccatggacttcaaggagctcagaggctcaggggcctggggaggaaacaagaggcctggcctgagcacttgggctgcaggagcaagtgcagcctgacacaggccccagatgctctcacctgccctgtttgggggccgtggagggccaacgacccactccccacaatctacccatgacaggtaaaagcatcaaactgtagggaaacaatcggagaccacgacgcattcatcagcagaggaacgtctcgtgagtgggactctgcagcatggaatactacgccgagattttcaaaatacaagttcgtgacatactacagaagtaaacgccaacctgcagaatatgtacagtgcgctaccatttttgtcaaaggatgtgccaatagtacacgctccttcactagggacacctacacgctgggagagctcccgcctgtcttgaaggaggcaggaggtctacatgctcagctgtctgcctgtgactggcatggggtgactggaatcggggtgggcccagcccggctaggcttcagtctccttgctggaaacaggtaggttgggtctccagccccgcagccacagcctcgtttcctattacaaaggttacagcaggcttctgttccccaaagtcagggctggttcctcccatctcctccagccacgtgcagctgtcccaaaccccagccctgtgctggactctccacaacgagtcagtcgccaaggcttatccatcctgtctcgctatatcgcccaggcaggtctcaaactcctgggctcaagctatcctcccgcctctgcctccctaagagctgggattacaggtgtgagccaccacgcccagctatccgtcctgcttctaaaccccactggatggctcccttccctgtcgtgccaccatgtcccacacagcccaggcctgtcctctcctgcccagaccaccctccctctatcctgtcctcaccagccccaggggacctttccaatgaagtcatgttgttccttctctactccaaaccttgccatggttcccgaccacccaccccagcgattcatttttgttgttggtggtgttaaaagatatggaccccttctgaaaatctcaaagctgctgtttccctttttccagaaaaatgcacgcactataaatatcctgtccacctacttctaaaatttgggccgggcacggtggctcacacctgtaatcccagcactttgggaggtcaaggtgggtggatcacctgaggttcggagttcaagacctgcctgaccaacatggcaaaaccccatctctattaaaaatataaaaattagcctggcgtggtggcaggcgcctgtaatcccagctactcagtaggctgcggcaggagaatcgcttgaacccaggaggcggatgttgcattcagctgagattgcaccactgcactccagcctgggtgacagagcaagactctgtctcaaaaaagaaaaaaaaaaaaaattaatgcttctgttgggccagaaactgttccaagagctttatgaggatgatttagtcttccaaataaccctacatagtaggtataatcgtgactattgccgtttcccagatgaaggcacagaaaggacaatgccaagacttggacctggacagcctgggcgcgcacactgcctcctggacagcctgggcgcgcacactgcctcctggacagcctgggcatacacactggtccccccatggaagctgcgctacagtatactggctcacaagccaagccccagctcctgaccctcgatgatcaggaccccaccgtcctatcctgctacacccactatctcagccctgcagctggtggcactgtctcctgcagagtggacacctctctcctctctgctgcatcctgcccagcttcctaagcacacaggcagatgcatgctcctcctaaagcacctcctgaagcccttcctgcagctgttagcccccctgcctggtccaggtctcagcttaaacatcaccccctctcagaccttcctgggcctgtctcccaggtcaggtcagatgcccctcggtgggcccaccgcaaccttccctgcagctgccccagcagggaagcttcctaaagggtggaaccaggctgcattcacccaaccagtctttctacttgtgcagaaagtacaccagtctatgccttgtgaggacaaacggggacagaaactgagggcctgcgggggggatgaagatggagacccagagagagcaagcaacaagtgcaaccaagagaaaggaaaagagacccagagaaacagagctttggagggaacaagagaggaggtatgagagcccccagagatcaaggtcacggggagggtggtacagaaagacctggagaaagagcaagtgtgagaaggggacagaaagccagagagagatccagaaagagggtgggggcaaggggtgcagctagagacctggaggaaagaaacaacagagtcaggacacagaggctcgggggatgtccgaggagcccaccttgatttctggggcggtgctgaactgtggaggcccattgagcagggcaccggctgccttggcatcactgaagctgggcgttggggagctgggaggattcacaggcagtggcaccaggaggctggtccccctgagttgttccctgagcctggccacgcctcnccgcccgttggtgctgccgcactgggttccttcctggagagagagcatggaagagggggttgagaggagggtccctgagggtgggatgggcagagaggcctggctggagagaggggagactgcacagatcagatgggatctgagaggggcaggtgagggcagacagatgggagaaagaagtggttctctgggcaaacaaacgcagagcccaatctttggaatggtttctcatcagcagagcagagctgtgggggtgggggtgaggattctcgggtgctccaccaggccacaggctgatcaaaaccacttgccctgggcaggtgttcacagggcccactcccccttgggcaggccagctggagctggggtgagggggcaggaagcaggcctttcctttgtgcacactgatctttcttagggcattcttcgggaaacaggcagacccagtggaatggtctgagctaagatttgaaggagtggctgcagaggaataaggacttcgggacaattcactttgaaaagtgaaacagtgaccctccggtggcagtcaattggcctcaggcaggtaacagaaatggggaggaaagggtatggggctcttgagaaaacttccacttagatgagaacgtattttagaatgttctgaagggcaaagcagggaggctgatgtagtttccttgctggaaagaagtgggggtgtaacacccgatggagatggaggatagcgcttggccattcccagcagcaagggcggggggttcagaacccaccgatgcgggggtgaggcgcctgcgcctctctgtttcaaaaggctgccatcccaaccctgccgatggccgagacactcacgaggtgctgggaggtgggttgtgggggccggaaggggggcccaaggcctggctgctggcattgttgcccccactgctgctcaaagccacctctgccgggctgtctgccacaactgagctgtaacctgggaacaaagagtaaatggaaagggctgctgcctgctgcccagccccgcccacgccccccaccccgctgcctcctcactcactggtggcgccattctgcttgccagcccctccaccggcactgctgttactactgctgctgctccctccgcctccgctgccgccgcctccgcctccgctaggctggacgctggggggccggggctgggtcgtgctgggcccactgggagctggtggggcacagcctgggcatagggagcaggggtgcccgagttgtggctgggagctggactggccttggggccagggcacttgggggtgctgcgggggcggggaaacattgttgccaggagtggtgctcaaggcagaggcagcaggcggggggccggagaggtaggtgggcggcacagctggggactgagggtgctggttgctgtggacaggcttggagccgtttttgctggagactgcgggtggagagagcagagggtcaggaccagctgggccagctggtctccctcaccacccccacctcaggctccatctttgtcccagcagcctcctctctggcctcgctgcccccacctgctcctgccctcttggggacctgggtgaccttactcaccctcatggcttcaatcaccttcatgcttaaaacactcacactgatttccagcctgcccagcttcccaagtcctgcctggacaccgccccatggacaccnccacagggatctgacacacaacttaggttgtcagccagagaagatccatctgttggaagccagaggactagtgggaaacacttaagtgttctcaatatgagattagctgagcccgcctaatgtcccaagagtaagaaggaaaaacagctggaaattggatagtaattctgaatgtcacctgaagggtcacagaagctactcacagggctggaagttaccagcactccagaaagtggtgggagggtaaatgtgctcatggtatccctaccgcaggcaatctgcggacagcactcgggctgctgagcctaaccacctcctgggcttctttccagccaccccacaggcaccttgcgcttaccaagcgcccaacaggactgactacccacttctctcctgggcatcgctgcttggcagtgggggcctgggaaggtggcagagcccagcctggcccctggagtacctgcctcagtgtctctcctcatcacctcctggccctgttgcccgccctcactactacctgcgggtccccttagtctccacaccagcctcctcaatgcccactcagggtgtccccttggaaccatccatcccgttagcccacagaggggcctcaggcccatgctgctcctgcctaacattgttctgtagcagcgtttccgaaagcgtgctcctgtcctgggagatgtcaaaggagttgaagaagcactgcccgccaccgtctcctctcagaaatttgcagtgtgtattatcagcacagcaaaggccccatcgcttcctaggcttattggactctggaggccactcaggtccacaaagcctgagcccctcagcctgacagtcccagtccctgtgctcacagttgggcccctggccctgcagacctggccagactcatctctcctcacttccaaactttctgtcacaacttgcccatgttactggctgccacctctccctgccaggcaaactcacctgactgtgaagcccagggcactccacagcagcatctcctgactgcctggccaggccaagggtgacctgtgtgctacccccttgaccacagcaccagtcacctgtccacttgccctgcccacctgccctcagggcagcactgatttctgagccacctgtgtccaccagcccagcacagtggccggcgctcaggcctcaagatgcctttgggaagcaacagaggagtgaatggcgtgcccacccggtccaggctcacacccacctggctgacttcactgtctgtggaacgtcccctcttcttatcatcttcagagttttcctgaggtaggggaggcagaatagaaacctgtgtgacctctggggctctgatggagaaccgccaatctctgaatgccccggggacctgggcccaattgactgccattgcggccccagagctggtcaaatggctgtccttaatctgcctggagaaaccatctcaattcaggctctccagtcttcttgttttctgggagccagcactgacccaccagcctcttaaggatctgggaacctgctctccacagggaagccaacccttggatccctgcccaaggtggccagctacccagcctcctcaggcagcccaggcaccggcccctcccacttcccagatccaggacctaaactggcgcgggatgcaccctattgctctttatgtcctttagggacccagatataggaccttagcgtgtgctccaagagcctagaccctggatacctagatctgtgtttcctcaattacgctcccatagccactttggagtgacccagatttgtctcctcgagtcctgccctgctggaaacacaaggtactagtgtcccgtggggcctcaccgtggtacagttggctgggctgggcgggatgggagagctggaggtggttgaggtgggcgtgctgctggactggttgaagatctcatcctccatgtggctgtggctggggggggaggtggcgaccagcgcctgtgctgtgggggcagaagaagggcatgcttagctggctcacacagcccattctgggccctcacttcctgtgccacgatcagccccagggcctcacgaatgtcctcgaggtccaggtcatcgtagagaaactcgttctcctcgaagtcggggtcctgggatgagtcaacatagtactcaacgtcgt

SEQ ID NO: 1888 - DNA, 1438 bp, Homo sapiens
gcccatatcacttaaaaagttcaaagccaaacaatgtttaacctctccttttttacattgtatggactttgtatgctgaagcttcattcagcctcctcctggttcacattgttattgttaatatcattatttttgtctgtcgtttattgtcagtctacaaattagatattattattgtttttgttttatacaggcaacatttatctggatttgcatagatgtttaccattttctttactcagtgttttatcaaatacatcctttaggaattcctttaatttggtctcttgttggcgtatgttcagttttcatttgtctattaaatgtttatcacttttttcgtgataggttgttctgctgggttcacaattttaggttgccagttctgtttttttgtttgtttgtttgtttgacacttggaagatattattctagtgtcttcaatattctgtctttggtctttggtcattctaattaccttttctttgtatatgatctgtcccttctccatggcttcttttaaaatcttctctttatctttggtgtttttcagttaaatatgtaatagaactaggcactgatttgtttatatttatcctgctcgagacacatgatgtttcatgtatctgtggctttttatagtttaaaataatttctggaaaagtcatagtcattatctctttaaccgctccctctcttccattctctttgttctctcttcctcgaactcctgttagtcatttgatcctccatatctctgaatatttttgtatttcttttattatttatttcttgtctctgctacattttacattgagtaaaagtgggatgtgacagtgggaaatcattagtgacttagaaattccagttggtcattgggccaattttgatgctaccttctctcttttatttctcactttaaaataaaatttgcaaaaacaaaaaattaaatatagtatgagtccagttactggcctaaggagctaaaagcattctgggtttgtatgaagacagctgagttataacaaatgagagtactgttgtgtgactgcattaattattccctttttaaatgtacaagagcaaggcattctacctgactgtgttattgagctctgcagcatacatgtgacagagctaaaacaaacaagcaaacaaaagaaaccacagctttaggatactctgttcatgaatatagcctgaaaatgataatcaagaagtaaacttttaccagtattaaggaacattaagctgcctatctctcagtgaatttcagaatgatattttaaaagttagtttaggctgggcactgtagctcatgcctataatcccagcactttgagaggcagaggccaaggcaggaggatcacttgagccccggattttgagaccagcctgggcaacatagcaagacactgtctctaaaaaaaaataaaaa

SEQ ID NO: 1889 - DNA, 329 bp, Homo sapiens
aggaaatgaaacccttctgaaaattggtgaatgcagtcctgtcagagatttagatttttgaagatgctgatacatagaagattggaagacatgaatatcttaaatgttaactacttttaattcattggtctaagactcagtgttaactgtcatgtataagattttattatttgttttatgttgcttctgtatataccttgaggtgtttaagaaaatatcttgtttcaaactgggattgaaggaagttatctgcagtctttaaaaaaaaattcttagaataattaagagaaatcattattattgtaccaagcctgtggttaagaagaaat

SEQ ID NO: 1890 - DNA, 2971 bp, Homo sapiens
gggaaagtgacggcccaaacgccagggaggagccaggacctcgccctgagctagcgggaggtaacggcggggagtcctggggcggagaccgagcgctgggggcgtggtctccagcgggactgggcctctagcgggagtgggggcgggggcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggtgagtacgccggcctccagccccggcactatcgttccccaaccctgcggccccatgggagcaccgtccgtcccggccccaagaccacctcgaaccgcgagtctccctgctttccccctggcgccgggaccatccctcctgttccctagccccagatggccccagcatccaccgtggaagcctgagacaccgactttggggcctggaactccgaacccttccccagctccccctacccggtccgacagcggacacccagacacactgacgcagtctcctaactcttctcgtggcctatgactcccaatcctgtcccaacttcccatcccccatcacttcatgttttcctggaattcccccccgacccggttccagggctggaggctccagaaagtctcttttccttctcctggggggaaagaagactttctgggtgcctcctcccatatgcaggatccggggaagggggccaactcggaggggcaaccgagttgggaacttggttgccaacatttactctgcagcagcctcccatcctcccccaaccaggaaattcccgttcggagtccctgtcttgctatgtgactttgaccatcacagcccgcctctgagctttttgtcagctctgtctgacaaaagggtgtagaatggttgggtgccggtggtgcacgcctgtaatcccagcactttgggaggccaaggcaggaggattgcttgagcccaggagttcaagaccagcttgggggacatagtgagaccctgtctctaagaaaagggctgagggtaggatggaggagggctggagtgggtggtcctggggtctagactcctgctggatggtggcatctcctcagggaaggcagggaggagccctcccatcctcccatgtcagggaagcaaccacatggtctgtggggctgggccgcaggtggcaggcagggtgaggtctgcctgtgtagagtagggaccagatggtaggtgtctccaatgggggcccccagggccattctgaggtgtttccttctgctctgcctccactgtgagatttcagggatcaaaggccaagcccaggtctctactgcttaagaggagcagggtgatcatttcccctgggcattgggagtcagtccacagccagtaggatgtacaggccccaaggctggcaggcacactgtgggtctctggccttgctcttttcccctggtgtctctaggcctgagtctccccacctgtatacacagttcccccttctgcccacaagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgagtttgaaggaagaggtccctagctctgttccccctgagcctcttggggagtgggcaacatggtcccaatgactggggcggggaggggggaaggatccctaggctgagagtctagcctaggctgagagtctagcctgcacctgacttgctttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactga

SEQ ID NO: 1891 - DNA, 23307 bp, Homo sapiens
tcgttgaaaaccaataatttatcaaaacgctgcgtgtgtatgtgggggggagggtgtcgcaacagacagggcagcggtgggcggacgcacaggcaggagacggtgcccggagagtgggggcggcagcttgccactggctggccatgcgggcgggcaggctagacattcttgccgcgcaggcgcagttcgtggcgtcgcaggtggttgtagagcgactgcacataggtgaagacacacttggggtcaggcttcttgcccatgatcatcatgtcgtccacctccaccaggggcacacagtccaccagcatcctgcagggagggggcacggggttggatgtcagcgccagacccgcctctcgtggcgcccctctaccccaaggtcttttttattgccgcattgcctgctggtctttcataaactccagacagggaaaagccttccaggaaggcaggaagcccctggcttcatctacccaagcctggaggcatctctcggggcgggggagcagagctaggcaggtggaggcggagatggcagaagagagccccatcccagtcaggcaggtcctgggtctgcttcctccaaccctggggaggtgctggctccaaaccctgcccatgttctccctggagaccaccttctgctcaccctcactggcacactccagttggtagaagcctctcagctcggcctttgcacccagatgggcttcatcactggccaatctttatctatggataggtctcactctagtggccctgtggtccaccgatgattgtctgctagctgcctgatctggtacttcctgttgagaggcccagggacccctattctttgacagggggtggggataaccctgctgctggagatggaggccagggaacgtgtgggcagcagaggggttctctaacccttatcacctgccttgggtagagcagaggaggcagatgaggatcccagccaataccaatggaccatctatgccatgctcggggggaccacccttctggccatccttcagaatgctagctgcccttcacagataaggaaactgagtcacagagcagaggagccatttgtttcaagccccatggcttagtaagtgcaggctaggccgcatgggacccaggcccccagttctgggtgttggcaaagccttttccccactctggagtgagtgggttgtgcctattaagcaactgacagctcccagagctctgaagctggagtctgctctctggctccttttcccctgtccctcaacccccagagcaagacctcttctgccttgatccctcctatctgccatacctgggacatagcaagcattcaatgttgctgaatgagtttcctatggcagggaaggcataatggcaacaattgctccttattctcaagacacctgagaacccaagaccacctcccatctcgtgcccttatggacaaactcagaactgtggtagggctgggcctacccccagctcacctggactccttcagagaagaaacctgggaggcagaacaccgaacacctctgttttagtccagactgtatccctaaccagttgtgggtgctagataaggcccttttctatgactgtttccccctctttagaacaggacagttattctctatctcatttgagaccttacaagaatttaggatgagtgagagggttctgggtctgctgctgatgtgccacgtgcccctagggtcatccctatcccagactgggcttgtttcccgagctgtaccatgatgcaaaggcagcctctctctgaagcttcttccagctgtggctatcgtcctggggatcccgaccgccctctccaacctggtgctccctcccgccccactcccttccctggagaccttataaagccattgtttacactggggctcagggctcagggctcaggctgccccagtgacaggccaaacaccaggcaacttgagcaacagcacggctgagtcacactttccaactggatcagggctgggctgggcccctctccctccaagctggcttgctgggcagcagctcctaagtccatatatgatctggagatagcaccaagcccatccgccactcatctgtgctccttctctgagtgtgtgtgtgcacatgtggactgccccccacaatggctccaggccctgaggggcatctgagtgtgcccctacctgtcactgactcacattccttcagccaatccccttgctccttctgggcctctattttcaatcctctctacaaaatgggcgggaacacagtgatggggcaaggaaaacagccactaagtggggagtttggagtctcagtttctggccccagctctgacctaaccatcttccctctccctcccacccccaggacagtcttagcccacgtctctctctgagctccttgtctgtaatggggtagttagtttaggatctgaattctttactttggtactgaggtgaggtgaccagagaggaaatgccacagctggcttaggatccagagtccccagccagaaacatcttcctgttgaactggtcctgctcctgagctccccactttggagtatggcaccaccaactccccagtgcccacacaggagcctggcagacttcttgaccttccctctccctctccaaaccagatctattgggaagcctgtctctctagctcttaagctattccagtcatctagtccatcccatctctcatccaagcctcatccgaggaaggtcctagaatgctatatccatcccttctctgtttggaaaccctttataactcctgttgtcctcaggaggaaggtcaaacttttttttttttttttttttttttgagatggagtctcgctctgtcacccaggctggagtgcagtggcatgatttcagctcattgcaaccttcgcctcctgggttcaagtgattctcctacctcagcctcctgagtcgctaggattacaggtgtgcgccacacgcctggctaatttttgtatttttagtagagatggggtttcaccatgttggtcaggctggtctcgaactcatgacctcgtgatctgcccaccttggcctcccaaagtgctgggattacaggcatgagccaccgtgctcggccagaaggtcaaacttctaactgtggccccctcctccctcatatccagactcaagtttcttcccttcctgatgtgctgtgctctccagctctcttgccctgctaagcctaggctgattcctctgcctggaactccctctccctcctttagcctgaacttgttcagatcccagcttagtttgcacttttttcagatggggggcccagacctgcagcctgggtcaggcatctcccctgggcttcccccatcacagtgctgcccacctgggtcatcactgcccatttagaatggtctcacctgctgggccctgaactgccagaagacagggctatgtctggctcctctggcttgactaaatgccccccttacttcccccacccgcctccctggaccctctctggccttgctgagcagattctggtgaaacggggcaggtggtagaggcggcgtttctcaccgtggggccccgagcaggggttaggactttttggtttttaccagccccttctggaccagacagcggtagaattcctggatgtacgtgtacacgcacttccagtcaggctctcgaagccgcaccatgtcctctgtatccaggagctgcgggcagtccgcatgggtcctggggagggtagggggccgggaaggggtgggggacgggggcaggaggccagggccccgggtggggaagagagggaagaggcagagaagagagaggggaggaaacagagacacacacacatacacacacacacacagagacatgagttcaattacgattccagtgctgcagtctgccagccccccgcatgcctcctccccactgtggacgtgccgctcactacccatcactaatggtgtgcaatgcagacaagggtgggggccaaaccagtcacaggtgcagagaactctaggggcaagcgggaacgcggggtgggggcgatggcgttggcaccaaggttggagaggagggctgtgccccggggagagggggtgagggaggcgtgagaggaggtggggggaggaggaagaggagaaggaggaggaggaagaaatttgagggaaaccagaaagagaaggggaaagaagggaagacagatggagaagggtgctgagggtgaggtgagcagacggggcaacgattccaaagtggagggcttgctgaggtcctatataagcctctggcagcactatataggctgggcgggcacggtgcccgggccaggagcctccttttggaatctccagccgggatcccgtgggagcaggaagctctggtgatagtgggaggagagcaggacagagaaagggagagagagggagaagggggcagagggaggatggaggggatatggacagggccacctggtgggctttggcccgggctggtaggccggcctgcggctccttcgttccggcgggcacctggcacgctcagcagcgggggggtggggatggagaaggacggggactctctggggaagggggtctcagccgctgactgacaatgtggctggcccgctccaggggttctcagggcaactgggcctggtcccgatgtccagccccagatgtgcagcaacattagcagggccagggcccacacttactccgcagatgagaaggccacctcgaagttctggcgtcggttctgagggctaagctgcccatagtcgaaggcctcagggaagaagttgtgcaccagggcacagaaggccatcccatcactccagctggaggagaagttctggatgtcgacgtgctataagccgtaggaggactggtcaggaacctgggggcaactcccccctgctgtctacccctcagcattctgttattccagacctagggcactgggcacaaagaggccccgtagcttgcacaatgagtgaatagttggaacatgagcctcctccaagtcagcctgtcaactcccatatttgcaatttcaagggacagagctactgagaggcccagcgccacccagctaaggctatggtcatgcctcatcactccttccctcatttagagaaattgactcagggcctcctacagagcaacaaggaggggactccaagagtgggatccggccttgaaccctgcccaccacccaagaggccctgttacttcatcactgattctggaatctagggcttgccttgtgtcctctttgagcctcagtttcctcaccccaagagcctttccatgttccctgtgaggccacacagtggcaggaagtgtactgggtaataggagctctgctaagaaggaggtgttgagctggggtctggggaggcctccaggccccctggcctcccggggctcacctcgtagccgcgagtcttggctcgacaccagtccagcagcatctgcttgatgctgttggcgttggggaccccgaagctggtggatcgctgcacggctgcgcggggtccgccagggctgctgtaggggcggtgtcaggaccaggtcacacgactataaggggcatgcctcggtgggcccacccagtggatcccaggccccgccttccatgaccttcgggcctttgcaccacagatctagccgcgcggtcttcccgcctctgccgggccaactatcaagccccgccccccactgcctatcacgccccgccccccactgcccagcccacttctgcagctcacccggccgcgccctccttctccagcttctcaatcatggccttgcgcgcctgggaggctgaggtcttgggcagactctgcgccttcatcagctctttcttcttctcggcctgccgtttctcgagcgccgccaggctgccggcccgtgggctggcctggtcctcgcggtcgaagatgctaggggttggggaggcgcatgttaggcagggagagcagggctgctccccagcctggaccaccactcgcgaggaggagggggggtcttgtagcacactagtatctccactgccacaaacgcctgccagggagggaggcgtcctcatcacacgcattttagaggagtacactgagtctcaaatgacagcaaggttttcaacaggtttccgcctccccctcccccacccacgagtagttctctgagaagcctcattgtaccctcaagttacaggggagttcagcttctgggcactatccgataataaaaatgatgactagcataataatagtaataataataattcatctctgttgatcctttcctgtgtgccattttaaacttcacaagagcagggaggggccttaccaattccactaaaggtgaggaaactgagacctctggcagtaacttgcctaagatttcagaggacgtgatgggcggaactagaacttgaacaaggtctctctgattcagagtctctggacccctttggttctcatcctggattctgatcctgttcctgctttctgccagccccaacagcctctgttacatgggggtaccctcctttctcatggggctaaggtataaaggtgctgtgtgacctgggacatggtttgcagatactgggaagtggcagtgccaccaggcagctcagtgtggtaggtaggcctctgtaagtgttcaatgctattgcagccactcagagatgtgagcccctaagcaactcactggcctccctgagcatccacctctcctgtggtgtggttgagaataaaatgagatcccaaggagagcaggatccttaactctcactttgcccctccctggctatagacctattacctcccagcatcccagtctacccctctgttttatttatttatttatttatttatttatttatttatctatttatttttgagactgagtctcgctctgttgcccagactggagtgcagtggagtgatctcagctcactgcaacctccgcctcccaggttcaagtgattcttgtgcctcggcctccccagtagttgggattacaggtgcctgccaccacgcccggctaatttttgtatttttagtagagatgaggttttaccatgttggccaggctggtcttgaactcctgacctcaagtgatccgcccacctcggcctcccaaagtgctgggattacaggcaagagccactgtgcccagcccacccctctgtaaaacgggtttgcagttaggtcccctgtggcactgactcctctatggtcagggattgggtgctggtgctcacctgcccatcttcttggatgaggaggaagaggagaaggtcttggtttgcatcatggtgctgccactgccatctgcaaaaaaggggaaggggcaccaggtgagggcctgggctggacatcaggagatgggatgggaggctgtatggaggggtggtgatagccgcaggcagagaagagaaagtgacggcacagttgaagacacggagagagagctcaaggaagagccggaggaggtgggcggacaggcaggcaggcacagggcgacaccaggtggccttactctccgagcgcctcacgaaactcgactccactgtggtggtgcgggccgtccgtgtgccatcatctgcaggggcaggggatgagaaggatgtgaaaggcacagggggctgggggaggatgtgttcccaccctgagccctgggccggccccatttggccccttactggagtggacgagccgctcagtcttggtaacagtgctgacagcagagccatcagctgcccgctggctgtgcctcgtggtggtctcagtggctgtgttgccgcgcccctcccctggccggccccgtgcctcctgcagccgccgttcccgctccttgtcccgctggtctgggcaggggatgccccatgcatgcgcaaaagggccaccaacacccacacagcacagatgcacaggtgcatggggcacacaagacggggtggagggtggcttgttagaaacatgaatgacacaggtaacaagggcctctctaggagcagctggggtgaggggacagccataacttgacagggaatggagtgtgggaagggtttgatggactcaggcagaaactagagaatacggagtagctaaactcaaaggggtatggatccaaaaagggtttctataggcatgagtagctaagtcaggaggggtatctagatctagtgagggggtagctgagtccaaggaaggagaagctgagtgaggaagtagctgggtgggccatcagcaggtctttggttggaggagaagagcagctggaggcaggaatatttagatccaggaagggagcaattgatgggatctgagaagcaatctgatccaggggaagagtagctgggagagaagctagtgaagggggttaactgggcttaaaatagaagtaggtgggtagagatagagactggggtggccatcagtgggccctggcagaagcagctagattcagaggagtaattgagagtgtttgagaggagaagcaattgaacccagaatctaagggaatgaatagatgtgtccagggaagaactatctgggggaggaagtagttgtgtccaggaaaagggaagctggatggggcagaggctaagatggccatcaatggacttcagggagagaggagcagcagggagaaggagtatctggattcagggaaggagtcgttgacagtactttgagaggcaactggatccaaggagagagtagctgcgggagggagtatctgggtctaggaaggagaagagaagctggttggggagaataactggggtcaccagcgggagagaaggagctagggaaggagcagctggatccagcagggaatagccaagggaactgctgggtctagagaaggagaagctgggtagggcagttattaagctggggtgtccacaaatggaccccagagtatgaggggagcagctggggaatggggcagctggatctagggtagggcaactggctctctacctctcttcctttgtcggagctcacgaagtgcagcccggatgagcttccgctcttcaaagtccgtgctctgatccagctgcatatagagcccatcattgcctacctggtgcctgctggcctctgccaacccccagcccaccggatctggctataccatcttgtccaagactccttcatcctcaatagtcatcagctcctcagcgctcagagggctccgcccttctggtgctttgttcactcgggtctgctcagccccattggccgcttccactgctgcagcgagaggctctgctggctctgcttccatctgcagggtggggagagggcatggactttaagcaggggtatgggtgaaactcatcatgtctccaatggatagggaagcagatcctagggttgctggcacgccttggaaataaccactagcctgccagcctgcctgcccaaagatggccatgtcagcgtcagtcagggaagaggcactgacagttttgttgtagggcttcccacgtaccccgaattgtattaatacaatggatagtgataataatgatgatttccagtccatagtaagtgttgtataaacactagggactttactgtccctatttaacagaagggaaggccgggcgcagtggctcatgcctgtaatgtcaacagtttgggaggccgaggtgggagggatcacttgttgccagcagtttgagaccaacctgggtaacatagcgagaccgcatctctacaaaaacaaaaataaaaaattagctaggcatggtggtgtgcacctgtagtcccacctactcagaaagctgaggtaggaggattacttgagcccaggagttagaggctgcagagagctatgatcatgcagctgcactccagtctgggcaagagagtaagaccctgttgcaaagaaaacaagaccggaaaaaaaaaaaaaaaaaacagaaggggaaactgaggctcagggcagctaactgacttgcccacagtctctctctaagtgtgatgcagcctgggatctgagctgaaggcagcctaactcctgaaccttagttcattttgctgctttgttcccagccccctcccaggcaggctctgctctgtgctgccagttcccgaggcctaggtcctcctgggccagtgcccaggcagcacatgttgccccccatctgcctgctaccttgccaagagggctggcccggggcctgtaggctcctgaccaggtgtctgactggggctgccctgagccaagacctctatgaagctctcctctgtaccacctccccctgcctcgcccctgctggaaaccatcctctaaggagtctctagccctgcagccctcccagggcatctccctagccccttgaagacaaggccccaagccaactattatggcccttcctctcctggcagggcctctccgtctgctataagggtaaggagagctgaggtggcagctgtttcagggaggcttggtctggccagggtgcagggcggcagggagctgggggctggggcctgggtcatgccaggggctgccaaggcagctgccacacatgcctcagggctggagcctggcaccctcttgccctagtcttagagcactagtgccccagtcccctgtcaagatagataaactgaggctcagagaaggtggtgacatacctaaagtcaagaggaggcagagcctggctcaaaactacccctcccaccaacccagaagcacttacgagactagtgctgcgggtggtgccggtggaggagcggcggcgggtgctgaaggcaggtgggtgggccacgggggtcccggcatcctcggcagcctgaaagagggcctcggggtcggcggcagccaggagcagctcgctgggctccagctcaggctcaaggccggacacaagtgggacccccagccgtaggctcagcacctccacctgcctgctcagtgcatccagccgccggctcagtgctgctctctctgcccgcagctcttcagctgcccgggccaccggctccacggtggctacagctacctcggctgcctgggtcactgccacccggcctgcttcagccaccgcccgcagctcctccagtgcccggcccaactgctcctcaagggctgcggccagctcaggcccaggccctggtacccccggcatggtgctggtggggactctatggggggtaatggtggggcagtggcaggggctgctgtctctggctgagtgtctgagtctttgcagctggtccgagggcaaaggcaagggcagcgggcctgccccgcccctgcctcccagcccgccaccagccagctggagctgcagcccaaatagaaacctattctgggctcctccgtggaaggggcagtgggggagggggggcctgcccaagcaggcggatcgccaggcctggctatagccctacagaaatcataggcctgcagcacagtaagactgcatgggttctgaagatcactgagatcggggccccatgcctcacaggtggggaaactgaggcagggaacagggaatggacctggcctagccaccatgtacattagctgtgagaatcagtctgctggactccacagcctgtactcctttaccctttaccctaactccagctgttttagacagctggaacagatgggggaaatggaggcacagggaggcaggactttgagtgatctgctataaaaagtgtcttggtcttacataaatgccctctggcctgcccatggtgctcacgtccaaccacagactttgagcaagcacattatgggtacatcacctgtcccctttggttccagatgggtaaactgaggcaagttggtggtgtcagacccaggtctcactgtggcacctcccatccacctcaagggcctcagcgggtccccccaccccaccccacacaatcccttgtcagagggcagctggatcctgcttttttggaaaggaagggtgctttatttccctcactctctccctgtctcccctgagaaggcccaaagctggtctagccatctcacctcagccaaagtcccattcagtccctggtttagcacagagggcattacctgggcagccgggtggcccgcttggggatccctttcccggctgagctcccggctagtggatcctgggcttgggaatgaataatggaagggtgctgcgtattcagttcccaaggcacctgctaggctgctgcctcacctgattggcgcccctctgcctgtctgtcccccctcagagcttctgcccaacccccacagggaggttgacgcagatgctaatcactaatctccaatctcctaatgggccaggctgatcttggatgagcagatgagctgctctatacctcggggctgatgtccagtgtgggtgggcgcaggggcactggggctgccacaggaagaggggagcaagcccttaccaccctctctgagcctcagtttccccatctgttcaccaggaatgaaccaaccaatttcgaactaaggatcagagatcagcatccaggaagcttaacgccagtacagagtaagcttccgacacacttagggactgatatgctagggtctggccttagctctgccaccgactggctgtggtctgtgagcagccaccttccctctctgggcctcggtttctctgtgtgtgcagtaggggaggagcagaggaaccctgctagccctacaccctgaagcagtgtatgtgaggctgacggatggtgaggctggtggggtgaggaggggctcaccttgatgctgcagcctcctcggctactggggggggcatggctgaagctggtgacatgagtgacactgcccagccgagccagggtcccagggctgttgacacgggtgatggtgctcttgcccccactactggtgctgagtagggtcgggggcgcccgcagccccagtgtcagttctgagtggggagaaaggtggctgtcaggaggatcaggtggagtgagggcagtgccagacaaggttgataatgccctcgctcccagcacaccctttggagacaccctgagtcctggccgcagcacctgtcctgcatgcagaagtgcggttgcaggcactcatccccattggggaggcagtggggggcgcctacctgccctctggttgcctgtgggcagcagcacccggcctgtggaggcctggccacggccgtccttgatctcgatggtgaatgtggtcttcatactgccccctggctcggcagtgccgacggccacgggcagcggggcaccaggctcctctgaacgtgccacaggcccccctgctctgttttcaaggggcctagcagccaagccccgccccctggggccctcctcctgggggcagcttcgaagctgggccaggggctgggctactcctcgttgctccttgctgaaccgggaggaggtatcactggggccccgagaggaggagccgctggaggaggaggcaggggtggtgctggtgagggaggggcccaggagccttgcgggggtcaggggacttagggcagcctggggtgtgccatcctggagcctagcagccataggagaatcagatgtgaacttgtggacacgatcccgcacagagccagcccgctggaatgaggaaggtccgctggcaaggggggtggactctagaaggaacaggagggctgtcagcaactgggtgggacagggtctgcacagatcctaggcagggtgagaataggtagtacctcggttctgggctggttggcgggggctgagcaccgacagggagcgttggcagggtcggggtccagccacgtctggcaggttggggagggggtgatggccatgtggggaaagagaaaagacaggggatagtgggtgtccacctttcataatcctctcctctacacctccctagcttcccaccctttcctgtactcaacccccaccccacctctccatcccctcctggatctcccacactccggcatccccactcggctgcatctctcctacaggcacctccttctcctgccacactgaccctaggatgacttggacactcctgggggccaggcgaggcttaggctggaggaagggtgcccagatcctttctgcagatggggaggggggacagccctcctggccagtgctgcccacagctccagctgggagatgggtggactcccttattggggagaagaatgtgcctgaggcccgttgcctttcaaggctgcaggggaggcctctagccatgggggtggagggggaggctggcctagctgggggcggggacacttcaggggtggggtgcagtatcagggactgcatggacctgaggaagctagagctgccaggcacaagagcccattttctaggcagggaaagggaggcagggggaggggaagaaagatgcctgtgactacccctgctgggaccctcacctgctctcttggtgtcagaggggcctctggtggggctctgggcagcaggggtctctttggggccagacagaagctgcaagggagaagaacagggcctgagcaaggcctgactcccagacctgctcacttgcctggcatccctgcccctcatccagactcaccttgttgaccacctggccctcagtgctggggagcgttggagactcctgaggctcagggctggtggtcttgggtgggctggggggtggctctgggctgcctggaacctcagctgtaaggcactgggcctcggcaggctccaatggaggctcaggagaggcaggggtgggtgaactgctgggtgaggcaggtgagctggatgtgctcccaggtggggctcgcagcaggagtgtcactgtggtcacatcctggctggtgccttcaggggtgggggttggctttgaaacctctgcctgctgttcctgttcctctcgctctggcacctgtaagggacccacaggatgcaaccaaggctccctaggctttgaacgccacccccaccactgagggccaggctggcaagtgcccagggcagggcatgcaaagcagagtggtggggcatggcttcctgtaggcacacctgcgcaagcactggcactggcatgctaagggcagtctctgatccccacttcccaatctcttggcactacctagccaaaggggttcagagaggaccaggtcctgatgtcagtgggtgggtatggcaggagacctattggggacgggagccttaatagatccctggagtggaggttcctgactcctggcctcagcctggttcatctggagtgggagtggggtcctgccaggaccgtggacccagcggcctctgctggccacttggggaacctgcatggcctgacctctcacccacactctggaaaatagagtgaactgtgagccagctggggtctgacatgcaggccccataagccaaggtaaagatgtgggctgtgtggagggtgaggggcagccctgggacgggttgaagcaggggaggtgccagggccggatttgcatttctgggagatccctctgactgctaaatagaggctggatggcaggggtgggccccttacagtgaaataccagcctagcaaagacactcaggcactctgtgctaccggtatccatgggcacaggacactgggccactctcccaccctccttacctcacactgttccagcctgtgtgccgctagccccttgctgtcctctcttgagccactgttgggacgcccgctgtacaacctcccagccaaggtggcagctggaagggaaggagcaagtggcaggtgagtgacagggaggtgctgtggacagcagacagcagggcaggggtggggccgggacaggccacataccctcaatctcctgagcccgtacacggcggatggcagctcggatcagcttgcgctcctcatactcaccagcgcttcgcaactgtgggtaagagacaggtcgcgggtgttgggctgtggagtccaggtcttcacctgccctgcccccatcccctgccccagcctgggcctcaccagtgcagtcaattcctccacatcgttcatggactccagctgccctgccagccgtgccagggcagcccgctgctcagcttcccgctgctgagagctgcagagacatcatgactgtaaccaccactgccatggccaggtcgtggaggatgtgggctaagggtaggagccagaacagagtacccagaaccttggcagaagggcatgtggctgtgcacaccctctaactgcacactgatacacatatgcccatggacgtgggcactaataccacacactcagacgtgctggctacatcagcacggccgcgacgccacaatcagtacatgctccatgcccacaaacatctctgtttttccagaagcgtgtgtggacgtactgccattagcacatgcaatccacagatacacttgtgctcacgcctgcctgcacacatgagctgagccagggctcacactcaccttctcacccgcatgttccaccccccgctactcactgcagccagttctccttgttgtcctgccgctcggcacggaaacgcttggatgccagggcctcctcctcgcgctccagctcctgccgctgcagttcccggatggctgagcggatgcgccgccgctctgccagatctgctgtgacctccagctgcagtgggtgcgagaggcaggtcattttggctgccaggggcggagggctggcaccagctgcccacggctctgcctagggcacaatgtgtggcctgtgtccactccctgtgtcccaagctcttcacgtgcctgcctgcccacgcagggtcccgggggtagacccagcccactgtttcagggatcttgggtagtccactttgcattgtggttcacagagcacacaactgtgagtggacagccagaaactgcccacttgtgccaggtgccaagccaggcactcctttctacaactcgattcctgcctctcagagcccagatccccaaaagtcagggagctattgtaggaggaggagggaggccaccctgtgggtcactaacagggtccctagagggaaaggtgacagatgaagtccaccctctgagcaagggaggctccctggtctagtcaccaaacaccacagcccagctgggggttgactgcttcatccacagatggggaaactgaggacaggtgctcaggagtcctgcctggctgagggctattgtccccactgcactggcctggacctagccaccatggaagaagccagggtgcagagtgggaggaccaatcccccagacatataaggtggctggcactaggggccaccccagggccttatagagggcatccctgggtgacagctgcttctaccggttctcaacccctcagttcccgggaaattgggggtgactggtctaaccaggttcaggaaagaacaccttctctggagtgagtcagccaatcctgttgcctcccccacacctccaccatgtagagccacctgctacatacagatcctccgtggctcaagggagagaggactggcccagggttcccctggaagatagtggcagagataagcctccagtgtgggtctgataaccagacgggagccagtaaaggcggggtgatttcctctgtccccaccccccaaatcattcaggggtagggccaaagaaccctctatcatctccctttttagcgcccccccgtcattcctttctgcttagcgggaaggccaggtggcaagggtggggatgggatggagatagttttcagcagggagtgtgggctggcccaactcagccatgagccagcttgtcctagtctgaagagagcagggagagtcttgggggaagagccctccaggctccacattcctgaggaattatgagaagaccccctgaaactcaggccagagcccttagttggttccagccctagtccaatcctggctgggtgatcaagagcatatcccttaaactctctgtgtcttggttttttcatttgccagtgggtggggttgggaacagtgacttggcctctcctgtacatagctgcagttgcaataagcatcacccccatacttggttctagccagtcaggaggagggagagagacaagggggcaaatgggaagggcaggataccccgaggcatcagtaacatttatggagagcctgtgagtcaaaccctgtgctgagccccctacttgtcctaagcccacaaaaaccctagatactactgttattcccatttgacagatgaggagattgaagtccagggaggacatgtgatttgctcatggtcaaatgacctgagccaggatttgaacccaggtctctctgactccagggcctgccctaggctgaagatagctctgctactggggtctgtgtgtcatggtggggacctcagggatcctggcactgtgttggagacccctctagcctggactagagatgctctgaggcctaaggaggccttatagcagaggcggggggaatgaggctcactccccagcccccggtgctggctgtgtctcaggcctagagccttctgtggtacatttggaggctgggggctggaggggacagagggtccagccccttctgtacagagggtaaagaggcccagaggggcaagggctagccttttgtctcctaggtccccattctcagtgctctgggctcggagatggggtccttgtctctgacaaaagcctgatgtaggaacttggccacctctacagcacaacccccggagcttcagtgtccccatctggaaaatgggagcctccctctgatcccccaaagtgggtgggcaaggctggagactgacaacctcattccactggtcaccctctggcacgacccttccctttgggcctggaggcaaaggttggaccacagtgtctcctctgtgtgtcccgagttccacccgcccaggccccaccgctgtgtaaggagggagctgtgggagggagggaaggaagtacaaagcgccattgtctaccgagggggaaggggaaggggatggggcggtttccgaaactgcccagtgaaattctcccgggaggaaagagggtgcttcctccccctggggagccggctctccgtgtactctctgccctcgctgttgggaacgcctggcaggccctgaggtctcactgggcctcagtctccccaacagcacaacggagggggctctccaggctttcagtcccagctcccccggttgcccatgggggtcccgccggcggtggagggaagcctcgccagggggcgctgaaggcccgcaggttctgcgaccgccctccctcgcagggcgccgccctcgcctcgcccaccctgcctcgcgctaggcgccgaaggggtagccaggtaggaagacacccgctaccgcctgcttcagtgtccggatctaaagggaagaaaccaaggtccccaggacacccagctgagtggcggaggtcgaactcgaactcgggaccgaggcagagggcgtcccggcgggtggtggaggggcacgcggcgtgcaagtccccaggcgtccccattcctcccatccccggcccaatcctcaagaatgtgcgggagccggggccggaagcgactgcccgcgtccccaaatcggccagacgctggggcgcagggcgggcggagcgggcctagcttttccttatatggcccggccccgcggggaggagcccggctcgggacgcccccgttcttgccacgaggccagcgggggccgggccggcgcgcggggcgcagtaatggcgggcgccgggtgctggaggagccgctcccggggtcggaaagacttcgagaggcaccgatcccgagaccggggcaggttctcatctgtcctttcccagagattcaaccactgctccagcttctctccaaaactcttttccagcgccgcccgagcctcgcttaagagagggaggtggcggctgaagaaccctgagcctgcctgtggataccttgagatgaggatgtgcgggaaccaggcctggcattccctctttttggactgtgctgcctctacgacccccactgggacttggacttcctgagggaaggtcgaactgactggcgggcacctttggaaacctaacctcatcccctccaggctgcacacatcctgcggtgatagtggagaggcagacacccagagagtctaatgcgctggtccgagaacatacaggcagagtgccttggggaggtcatggcagcagctgggcactgcccagtggctgggctacgctggttggttccagcctctgcctgcgggggaaggtatgagagtggggtgggtcacttgtcttctaggtaaagtaaatctttaatttacccccatggacaagggtcagggactgaggagatggagctcctctggcccctcctccaggtcaggctgcctggcctttggggttggggaaggagccctgccccactgggttgccctacggcctctgtgcatggaggtagacagggctctcaggaagaggaacaagaaaggggatggagtgggctcatctttcctccacctgagatctgggtccatgcctcattctgtccccatgccaactctaggacctagagcttgtgtgcaaacacatctccctccctcccttcattttacaggtagaggaactgagactcaagagtagaaaaatgagatgagaagccacagaatccataagggcccacaaaacctgtctctctcttatggcctcgtccagccttgactttcccaggactctggtcccccgtggcccactatggggttgggattttggcacagctccttcttagatgggtgtccttgagcaggtgattttaactctcttgagtcgcagtgcccaggctttcagagctgctgtgattattctgtgacatggtatacccagtacccagcctgccccctgccaggccttggcattattaatcattgctgctaccattatcactgggccagcttccaggggtgggcattgcccgagctattgctctggagaggcatatccagcctccccacacctgtggctgcatacgggcgagtctacagcagttactgtttaaacaggtggtggctgtggagggttgggagggactaggcttcagtaccaggcatggacaggcacatgccacaagggcctctgcatcagccacatggaactggcctacccctgttcccatgtccccctcctcctgacctttcccccatcacttcttcctgtcagctgagaggtaccctggattgaccctgcctctctggcttggctttcctgtccccacagtgggtgatggggccacttaccagcttccgaagggctccctcatccagcccagctaaggcctcgtccgccatctcgctggcccctagctccgtcggttcctttctggtgagatccccagtgcctgtggcacctgtcaccagctcagagaattctgcaggggacagacatgaatcaggcatgctggggcttccagaaaccacaggcacttaggctctgtgccttactttccctctctaacctaggagcgtccattactgtcccatcctataatgtggctcctggctggaagctgccctctgccctagggtggtttgctggaaaactcaccaaacccagggtagggggtctctggttccagccctgccagcttggccgccagtctgctgtgtggcctgggatggactctcatcctgtctaaacctcaaaacagggagggcagggacctggattgagaagccagggcctggcaagacccacccaagctgtgcttaccaccagggggtgcactccagtctccagtttcctgccccacccacccatccacagggcctacccagcccccacccactccgcaggctcagcttctggctgtgggctgaacccgtagttcttgctgccaccaccactgtcattcccccaggtataggaaggtacactgtgtcttccgattcttggagccagctctgctgtccagacctcctgaagccaggtgtccaggcacccagcacctcctgccaattcatacagaattcaattccccacctggaagggctttcagaagctgacctgcccaacccctggatttcaggcaaactgagaagattggagagggccaaggatttgtcactgagcaaggaggaagccaaagacttagagggcagagaaggatgtaatcaaaatcttcgtcatctccggcttccgaagctcccttccaaagtgccctcaagggcctggaacactctcagtgacagaggcaagagccccatcttgccccagtgctgcccatcaaaatggacccctaaatcctggcccagcctcccagcgcagatctctccttcctcctgtagccccaactaatgtctgtctggaatttgaggggccctggtctggcacactgtggatgcttagttaatgtatggtgactgactaatgtgtggccccaggcctgccccccacctcctgttgattcatctttcaatcatcccttccctctcttcagaacagtcacttgggaagtcaccccatacggtgcatgggtggggggtgagggttaccgctccacacagttggggtgtgtgggtcccagcctgttcaagtcactgcttgttccccctcccatcctggtaggctcagaggtgtcaacctcccaatctctgcctgttaggatccttgcctcttacctagttactctgtctgggttaaacctcttcaagactgtccagtggtcaccagccttaggttctgcggacattctgattccccccatgtctgttcttctatggggcagctgaccctaatgcctaatctaggacacccatgggattataagaagatccctgccgctgctcttctccaatctccctgtcacacagtctggggtcgccggacattgtgaggggcctcaggattctgtggcagcttccccagggtttctgccgccacagactagcgcccctgtggggcgtggagtctcttaggaatccgggggcgtcttcccccaacagtctcataactttatcccatggcttagacctctcgtatgggtgggggctcccaggtctggacgttccagaactcctgtctagacatccgggttccacccccggacacgttggggcagcaccaggatcccccccgaggtccgcacacccacctctcagtccagcccacccgtccggcgcaggctcggcttagctctttcgggacccgacagacggattagacacgcgcaggccggaggtgccgcgacccgctgtcccaggcccgctcagcaaccgtcccctggattctgc

SEQ ID NO: 1892 - DNA, 523 bp, Homo sapiens
acctcctacatttatgagcaaagctcggtttccctttttgctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaaatgggggaaattgaatatggactgggaactaaatgattgaaagtagttttgttaatcttgttggtataatattttgtagttctgtttttaaactgctgcagtgtttatggccagagtctaaatgtttacgagttgctttgcttttaaaatattccaacaaaaaaaaaa

SEQ ID NO: 1893 - DNA, 522 bp, Homo sapiens
acctcctacatttatgagcaaagctcggtttccctttttgctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaattgggggaaattgaatatggactgggaactaaatgattgaaagtagttttgttaatcttgttggtataatattttgtagttctgtttttaaactgctgcagtgtttatggccagagtctaaatgtttacgagttgctttcttttaaaatattccaacaaaaaaaaaa

SEQ ID NO: 1894 - DNA, 11071 bp, Homo sapiens
aggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggtaaatttgtcttttatatgcctgattatagtactgaattagtgtgaaaagttgattaatagacttatttctgtaaacattgcatccttttttcttcctttttttcttttttttttttttaaagataggatcttgcgtccaggcgcggtggctcatgtctgtaatcccagcactttgggaggccgaggcaggtggatcacgaggtcaggagatcgagactatcctggctaacacggtgaaaccccgtctctactaaaaatacaaacaattagccaggcgtggtggccggcgcttgtagtcccagctactcgggagtctgaggcaggagaatggcgcgaacccgggaggcagagcttacagtgagccgagattgcgccactgtactccagcctgggcgacacagtgagactccgtctcaaaaaaaaaagataggatcttgctgattttgctctgttgcccaggctggagtgcagcctcgacctcctgggctcaagcagtcctcctacctcagcctcctgagtagcagacactacaagtgtgggccaccatgcccagataattttttgttgtagagatgaggtctcactatgttgcccaggctgatctcgaactcctggcctcaagtgatcctcccagaatgctgggtttacaggcatgagccatcatacatggcctgttgtgtcctttctaattttgacctgattcaaactctgcctctcagtgttaacaattggagtgactacagtttcactttttttggttatgctctctgctataggcatatcctaattgaaatctggctgtgtaaagtgagctatatgtgtttaaattaatggaaaaagtatatgtgtaagtgttctcttttgaataagccataatgatgctccaaacagatgattacattaacttttaaaaaataattctgatgtgtgggtttgatatgtttaattttgtgtctataatgaggaaggaacttgtttttctattctctaaatgttcatttatcagtgtgttcaataattgaaaaatagtacatggaaagaattgataattttttagtgctattcttaacttgcctaacacaatgaactaatcaatgtcaatgacttgaaatagtgctattctaacatgttcggtattataaaggaagtggtaggcttgctttaagtttttgcagggagtcttgctgtgttgcttaggctggtctcggaacaactcctggcctcaactgttcctcctgccttggcttcccaaggtgctagaattactgatgtgaaccaccatacctggcctaggctcgcttactctttactaaaagttgatagtaattgatttagaaaattgcattttaaagaatttgaagctcaatacttttagttttgttagaccttctgtcttttaaattaatatatatatatttgtatatatctggaagttttattagaccttaataatcagggtgtttttcttttcttttcttttcctttttttttttttttttttttttttttttttttttttttgagatggagtctcgctctgtcgcccaggctggagtgcagtggcgcgatctcagctcactgcaagctctacctcccgggttcatgccattctcctgcctcagcctcccgagtagctgggactacagacgcccgccaccatgtccagctaattttttgtatttttagtagaggcagggtttcactgtgttagccaggatgatctcaatctcctgacctcgtgatccacccgcctcagcctcccaaggtgttggaattacaggtgtgagccaccgcgcctggccaaataaggctatcttttaaaaacagtaagttcttggcatctggtgggtagaagccaggaacactgctaaataaccatacagtacacaagctggcaccccataacatagaatcagtctcaaaatgtcaatagtgctaaggttgagaaaccccggataactctaacaaactagtactttagtttttaagtcatttatgtcacaggcagtttaatgccttaatttgtcagtcttatgatttttttttttactgttacgtatttgtgatttatatattccttttctcaattaagagatacatgttatcaatttagaaatactaggatatctgagctgaagtaaaagttgcaaaatgcaagccagaacagtgtaatttttttattattaatattttttaatgtgaaacgtgtttatctcttgattccacctgtccccttccacttctggataaaactaaaatggcaggccgggcacagtggctcgcaccttgtaatcccagcacttcgggaggctgaggcgggcagatcacctgaggtcaggagttcaagaccagcctggccaacagggtgaaaccccatctgctaaaatacaaaaattagccgggcattgtggcaagcgcctgtaaccccaagctactcgggaggctgaggcaggagaattgcttgaacctaggaggcggaggttgcagtgagctaagtttgtgccacttcactccagcctgggcaacagagtgagactccacttcatctcaaaaagaaaagaaaaaaaagcttaactggcaactttaaagacaggagcagttacttagtggcaggattagaagttccttttagttcactaggtgacaatatgttacttaaggagcggggtgacgaggcttgtcagctaaatcacagtttctcttttcagttgcccaggctgaattctcagctaacacaggcatgttgtatggtttcttctgtatggctgagactgtctccagtctttagggacaggcaatctgaagtgatttgatttttttctttttttgttgtttgtttgttgtttctttgtttgtttggagatgaggtcttgctctttgccctgtcgcctaggctggagtgtggtggcacgatctcagctcactgcaacttccgcctcccaggctcaagtgatcttcccaccttagcctcccgagtagctgggacaacaggtgcgcaccaccatgcccggctaatttttgtattttttggtagagacggggttttgccccattgcccaggctagcctcaaactctggacctcaagtgatttggcctccccaaagtgccaggattacaggcatgagccacttcacttggctaaagtgattttttttttttgagacggagtcttgctctgttgccaggctggagggcagtggcacaatctcggctcactgcaacctctgcctcccgggttcaagcaattctgcctctgcctcccgagtagctaggactataggtgcatgccaccacacccagctaatttttgtatttttagtagagatggggtttcaccatgttggccaggatggtcttgatctcttgatacctcatgatccccccatcttggcctcccaaagtgctgggagtacaggtgtgagccatcgcgcccagcctaaagtgatttttaaaatctttttaaaatttgtattcctttttgactaacttctccctgattctgaaaatttcactgaagtttcaaagttattagtgtgcatatggtgaagataataatataagctcctcaccctgttttagtaagaagtacttagagattttgtgtgtgtttttttggggggtgcttaggatggggtgcagggagatcaacttagagaattttgatttttggaacttcaaatggaagatgtgttaaatttgttgcagctttgcttttgcagacatttatgtgatgtaaagttctttttaaaaattggaccgggtgtggtggctcatgcctctaatcccagcactttggcaagaggatttacttgagcccaggagtttgagaccagcctggggaaacatagggagacttggtctctacaaatatatatatgtgtgtgagagaataggaaaaaaaaattgtcccagaaacaaataatactctcagagttcttttcaaagagaccaaagagacaactcttatcttcaagaattaggctgtgcaaggcggctcatgctatttgggaggctgaggtgggaaggccacttgaggccacgagttaagagaccagcctgggcaacagatcttgtctctacaaaaataaatgcatgcaggccaggcgtggtggcttacgcctgtaatcccagcactttgggaggccaaggcaggaggatcacaaggtcaagagatcgagaccatcctggccaacatggtgaaaccccatctctactaaaaatacaaaaaattagctgggcatggtggcgcatgcctgtagtcccagctacttgggaggctgaggcaggagaatcacttgaacctgggaggcagaggctgcagtgaaccgaggtcacgccattgcactccagcctgtgcaacaagagcgaaacttggtctcataaataaataataaaatgcattccattgaatggaatactgtttagaccccttctctaccaagaatttttgttttaattagccgagcatggtggcacaaacctgtggtcctagctacttaggagactaaggctggaggattgcataagccaagaagtttgaggccacagtgaactatgatccactgccagcctgggcaatggagtgagacctccttttttttttttttttttttttaatgacctttagtttatgggacactcttacggagaaatatttgtggatacataaaaattgtgtagtttttattagtttattatacttttattagttcagtctcaataaaaggttgaaaggcattacgataaatttgttcttgtctgtttatatcatttcttcttggctgctcactgagtcttaatcagtgtactagactgcaaactaaagaataagattgggggcaggttataaaaagaacatgtataaagcttagcaaaccctttttaatgttctgaagtcagtctttgtaagtgaaatcgctggagactagaaagtatgaaatggcagtctacctgggcaacctacaaaaaatttagcttgaaaagacttcagtctccgctcccctgttgatctcatggagtggggaatgggaattgaaccagaactggaaaattatttaggaaagtttgttaactactctttgttgatctcatggagtggggaatgggaattgaaccagaactggaaaattatttgggaaagtttattaactactctttctgctgagtaaatttaaatgtgttctggacattgttgaggtctagaattgtctatacaatgccctgtacaagctacattgctgtcattttcaaaatcaggagtttatttggattacatatactttgtgcttaattttaagtaatgattacttcaagactggtgaattatacgtgactttttgtgcctgttctttataggctatggaaagggcaaatggaatggagctggatggtagaagaattcgggtggattattctataaccaagagagcgcacacaccaacaccaggcatctacatgggcagaccaactcagtaagagttcaagtttcctaagctaaactatgaaatccaccagaaatatgtgcaaaattttgattactcagaaacttttttcctataattagaattgattctggcaaggggcaacatggcaaaaccctgcttctactaaaaaaaaataaaaaatcagccaggtgtggtggcacatgcctgtaatcccagctgctcgggagctgaggcacaggaatcacttgaacttgggaggcagaggttgcagtgagcctgggcaacagagtgagactctttctcaaaaaagaaaaaaaacataagtaggggttttgataatgtttttaaatatacaaccctcctggctggctcacgatgttcatttgccgggcgcagtggcttacacctgtaatcccagcactttgggaggccgaggcgggtggatcacgagatcacgagatcgggaccacggtgaaaccccgtctctactaaaaatacaaaaaattggctgggcatggtggcaggcacctgtagtcccagctactcaggaggctgaggcaggagaatggcatgaaccccggaggcagggcttgcagtgagccgagatcgcaccactgcactccagcctgggcgacagagcaagactccgtctcaaaaaataaaaataaaatatacaaccaaaggcagtattcacagaggtatttcttgggaataaaagaaggaatatagtcattccttggtattctctttggtgtccagagttacttaaaaattcttggtgtttattgccttttagtcacagggatacaccttttattcatttatttatttatttaccagtctcatttagcagtaggaatgcatcttagcatttttatactgctgctcaacacagtgcttcatcgtttcaatttgttgaaaagattttaatttgggcagtgcattagtagaaaagcagttaatagttttgagagttttgtgaagcccttcttgattatgtatgtagggaataaggcaaaccagaataccatgggagtcagtaaaatgagatacggaggcaatttctcatgaaagggatgttcttcctcacttttctcttttttaagccattcaatttgtattaaagtgtcctggaaaatagtcattcacactaatggagaatttttacatttttctgcagtagtggtgggggtggtggaggaggcggcggcggtggaggtggaggtggtggcagacgtcgagattcttactatgatagaggatatgatcgtgggtatgacagatatgaagactatgattaccgatacaggtaatgttttaacttgagctttctgttctaaattagatgatagtagtgttacttggcacttttatgttggatacatatgaataaaaacttgatttttaaaatagatcatatatgacgcctttgggagcagaagttagcagtctgtatatgtcagtattttgttgtgctatatacttttctggtctcattggcagaaagagaacttaatattaagtagttatcaccttaggtacattattattttgaatgatgaggaatttttattttcatctgcctcagtggagtgattatatagtatgctaagtaatctttcatttcttacagaagacgatcaccttctccttattatagtcgatatagatcacgatcaagatctcgttcctacagcccaagtatgtgaactttacttttgtagcataaaaaacctcatttctaattaatggcttactttagaatattagagtataaggtggaaggtggcagttaatagttggaaaaatatgaggcaaattaaactataattgttaactttttttttttttttttttttttgctttttctcttttaggacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttgaaaatgggattgtctctttattgtggtaccatggagaaatatgattgaggaactggtccttccttttccctcacatccccccagtgtgtatttatatgaaagtttacccatcctgagttttaacttcccaatatttctcatttttaaaaatattttttcttacactagaatgttattccttgtcttttctttggttcttttaaaacccttgtttttcttctcttttgggggagaccgaattgtaaatattgagaatattcagtaccagcaccatgctgaaggaaagataggtagctaatacctttttttttttgagacggagtcttgctctgtcacccaggctggagtgcagtggcgcgatctcggctcactgcaagctccgcctcccgggttcacgccattctcctgcctcagcttcccgagtagctgggactacaggcgcccaccaccacgcccggctaattttttgtgtatttagtagagacggggtttcacggtgttagccaggatggtctcgatctcctgaccttgtgatccacatgccttggcctcccagagtgctgggattacagacgtgagccactgcacccggcctactttttttttttttttttttttttggagacagagtctcgctctgttgcccaggctggagtgcagtggcgtgatctcagttcactgcaagctccacctctctggttgacgccattctcctgcctcagcctcccaagtagctgggactacaggcacccaccaccacgcccgggtaattttttgtatttttagtagagggttttcaccatgttagccaggatggtctcgatctcctgacctcgtgatatgcccgcctcagcctcccaaattgctgggattacaggcgtgagccactgcgaccggcctataggtagataatatcttaagaagtctaaatatattccagtaggaaacacacttaaataactgtaatgtaaaagaagaagagggtgtttcaagtgacctttaaaaaaaggtgttgggcagctgggcgtagtggctctcacacctgtaatcccagcactttgggaggctgaggcgggcggatcacgaggtcaggagattgagaccatcctggctaacacggtgaaaccccgtctctactaaaaatacaaaataattagccaggcatggtggtgggttccagtagtcccacctactcaggaggctgaggcaggagaatcacttgaacctgggaggcagaggttgcagagagcaccactgtactccagcctgggcaacaaagcaagactccatctcaaaaaaaaaaaaaaaatttactgtttgaaagtcctgtcctttttaagtatattttgtgactagggagctgagctcagtagtgtgcacctgtagtcacaactagggatgctgagacagaaagttattttgagcataactactcaaaatagaaataaaagcttagatatttctggacctccactttttctgtttactattaagatctaaatgtggccgggcactgtggctcacacctgtaatcccagcactctgggaggctgaggtgagtggatcacctgaggtcaggagttcaagaccagccttgccaacatggtgaaaccccatctctaataaaaatacaaaaaaaattagctgggcatggtggtggacacctttaattccagctacttgggaggctgaggcaggagaatctcttaagcctgggaagcataggttgcaatgagctgagatgatgccattgcactccagcctgggcaacaagagcaaaactccatctcaaagatataagtgttttcaactggcgggtaagaaaaactgctgctgttggttctctaacttcttacaacggtggttcccacttaatcttatttaggtcctggagccctaaaaaaaaaatctgaaaaacctgcagtctgtcttcccagaaacacttgtgtgaaacgttctggtgtttttgtgttgagacagggtctcactctgtcacccaggctggagtgcagtggtgggatcacagctcactgcagcctcgactgccagactcaagcaattctcccacttcagcctctcaagtagctgggactacaggcgcacgccttcatgcctggctaatttttgtacttttttgtagagaagaggctttgccatgttgccctggctggtctcaaactcctgggctcaaacaaattgacctccctcagcctcgaaaagtgttgggattacaggtgtgagccaccacgtccagcagagtatttggcttttaaattataatcttgtgcatagaataagatctataagaatatacaccaggggccgggctcacgcctataatcccagcactttgggaggctgaggcaggtggatcacgaggtcagaagatcgagaccatcctggctaacatggtgaaaccccgtctctactaaaaaatacaaaaaattagctgggcgtggtggcgggtgcctgtagtcccagctactcgggaggctgaggcaggagaatggcatgaacccgggaggcggagcttgcagtgagccgagatcacgccactgcactccagcctgggtgacagagcaagactcagtctcaagaaaaaaaaaaaaaagaatatacaccagcctgggcgtggtggctcacgcctgtaatctcagcacttttgggaggccgaaggcaggtggatccacctgaggtcaggattttgagaccagcctgaccaacatggtgaaaccccatccctactaaaaaaaaaaaaaaaaaaaaaaaa

SEQ ID NO: 1895 - DNA, 286 bp, Homo sapiens
gaattgcacagcaacttgaactattacacacaaatacatattgctttgctgtggcaattaaaagcccagcattttaatgtattcctatccctgatgtcacacttaatgctttgggtttttagtatgaattttctttttccctcccaattaagttaaaattaaatgaatcaaatggtcaaaactagtgcatatttttattctatgaaacaattcagatacttattgacattaaaagatcaggggaggagtctttgagcatactctggctagggaagctgctcaataa

SEQ ID NO: 1896 - DNA, 754 bp, Homo sapiens
gtaatcatagctaacacttttattcagtacacttaaagcttttaacatttctgtgaggcaagttatgttatatataaaaaaaattgagtcttggatgtatgacattgaaggagttttagttttggttttggtttagtttttgctaactagcagtctaggtttcaaccaggcagccgggctctaaagttcttagaacatgtttgcatgctgtactatgcttctcccacaggatactaacttaaactgtggtggagcatgtcattatttaatgttttgaaatctgtaaatttatttctaaaatctggattgtgggaacactgaaagaatatcctcgctaaagaatgaaaatgggccaggcatattggctcacgcttgtaatcccgactacttgggaggctgagatgggaggattccctgagcccaaggaggccaaggctgcagtgagccatgatcaggccagtaaactccagcttgggcaagagagtgaggccctgtctcagaaaaaaaaaagaaagaaaatggaggagaggaggtctaaatcaacaattacagatgaagtcagattaagtacaaatctgtaagggatgtaaagcatttgaattaactagaaagatggtattaaactgaggatactttttttttataagtgagacggagtttcactcttataaaaagtaaaggttgttcaaagagattttcctccccatctaattagaaatagataataatttctcttagaagcaaaatttattca

SEQ ID NO: 1897 - DNA, 216 bp, Homo sapiens
ctgcccccatgcagtggtagtcaccgttctgtcccccgcgggtgctggtgagaaaggtaaaagggcggttccagagcctgagggcctgtgagtgcagtttacataactgccgaaacttaaggaagcgtctaaataaaaagaaacatgttaacccaaaatggtttatttgtttttttttttttttgggttccagagctcatgccaacatgcaaaaaa

SEQ ID NO: 1898 - DNA, 3598 bp, Homo sapiens
atggggcggccctggccagaagcggaggaggtggcacccgggaccgagctggggtcttggaggaagagagggtgaggggaatacagtactgggggtgagagaagggttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccaggtgggttagactttatggggtgctgggaggtgtggcagatctctgcattcttttaagaccttcttccctgctccccacacctgggaggctgccagaagtagtggaagagcatgagctttaggtctaccaacctggacctgagctcattatgtagcctcagtctacctcagtttcctcttctgtaaaatgggaatgagaccttcctcaaagggatctataaggtaattggcagagtgccacactcgaggggccgcccctctatgagtggacgcttcctttctcctccctcacctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggtgcagaccctgcccttcctcatctgcctgacacaccagaaatctaggggctgagttttgacctgggcccatccatccctcccccagcctggttcacaggggcctcctcctctctgcagactttgcccttgtgccttcgtgaagaaggctgcagcagcagccacctttgggcctctcctggcccagaaatagagcagtggttatttatttattttcagttgaaatcttacatagagtcccaatttataaaaccagtaatagtggatggagcagctctgggtggagagaggttaggggctcaggacacttctctctctgaaactgtgtttcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccagggtgaggtgttccctttctcccagctttgggaagtgggagagatggtaggggcagggaggggcccgatccaggtgcaagcctgtcaggacatccagggagatgggagatgagcccacttgggaattctcctccccttcacttggttaagtcttccgtgtgctacagcctgttgcttcctctgggaagccttcctggacttccctgggtggtcaggtttcctgcttatatgcaagcaggtacttctttttcatcgcattcaacacagttgcatgcttacatttatctctgtgattattttgtctgcctcccccaccaaaacgtaggctccatgagggtaggtagttctcttctccaccatgttctcagcacctcgcccagtgcctggcatagaatagatgctcaatggtaaatgaaccactccccgatctcctccacagagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaaggttagtgaacggtggagggggctgggggccaggagggccacagcagtgccagccactctcccctcccacagcttccccctctactccttggcagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtgggaagaatgagggtggggaaggctggggagaagagaggatctgatatatctccgtgcttccatctgtgcccctctaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgggactctggaaatatgaaggaactagggagtggaagagatttcagagctggggagaggagttcctcccttcaaagccagcaactgcctttggggaatgtcggggggtatctcctttctcctgcttgtgtgaggtggtacacagtccccccttcacctggcgggaagcctgtcccggacagactcatctcagctttcccttggggcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttctcttcagtgaa

SEQ ID NO: 1899 - DNA, 5689 bp, Homo sapiens
tttagaatcaggtggctcactgagctctgtattttgtttcctggagctttcactggtttcttcccctgagataccccaagtgacatgaaaagcatactcagggcctagagacactttactggggatgggcttctgtcacaggtcagaggtctgagaagaggggcaggccccactcctctccactagtagagaaaggttgacagagaatcatttcttgcttctcttggccgtagttttggttgtgctgggggcctcagccacagaggccttgggggctgtggctgctcgtgcccccttccttccccagaaagagctttggtggcccctgggaatcagactgcatggtttcttggtgggagaggaggcctggggtgaggagacggcctcagggactgtctcctccccttgcgcaggagtggcagaagggctgctgtccccagccatgggcaccccaggtagcaggggcaggtcggtgagggtgggctgcatctccatcctcagcaggtgctctgtcagggccgtctgttgccggtgctccctgtgcctgctcagctcctgctccagctccttgaggaagcctgggaggggccgggggtggagggtacagggtgggtggagccctgggctcagcaggagggtccctgggctcagggaagtctctggctggccccttgtcccttgtgggaaggagcctgaggctggggcccaggactgacacctggctctggcccagatgttgatctgaacttggggctcccctccccggacgccactgccaccttagcttccctcatgtcccacagggcagaggtgggctctggggaggctgaaaaccttggaaagcagggtcacctcgttctgagcagaatgggccactcagctctgggaactcctcatcgcttgaggcttcatcctcctcatccgaaatccagcgctccaccacaggctgcccgtccaggtccaggagaagtggcagggcttctgtcaccagctcgctgcagagcagaaggagcagaggttacccaggagggcaccctggcgtggaggatgcaaagacacgcaccacagcactcacacccggaggggtggtggctcatgagctaggtaggaggtgggggagaaggtgtcatggacaggaccccaggtttgcaggctgagaggggtctgggctgagttagcaggtagagctcagccatgacctttcttcccaccctccactccttaccggtagccatcctggttggtgcagctgtttccagacaggttgaggatgagaaggctctgggggaactcatctgcacacagcaaagagagaggaaatggggttctcacttgatcttagccaaaagaccatgaagcgatgggaatggggttctcatacccactttctagtccaaagccagtacctctaggcacaaccccttgaactccctgaggatgaaatgtggacctgcaggggcatggctaatagaagcatgggcagatgggtgcagaggggagggcaggccccacaggggatgtgtttggtgagccagggcgagtgggttcctacccagcttcaatgtttctatcaggttctcagaaaggtccagaaactggaggcatgggaggtcgaggaggttttccacctgcctgatttggtttcctgccagagacaggaagctgtaggggaaggaaggggtacagaggcagagctgaatcatggaacagctggaagaaaagaggagggcacctgacaccggggcccctgggctaggcagctgatgaccagtggggacacatggccttctggggtgagggagtagatctaggcttgctggtccttgactgacaaggacccaggcttggagaaatctgaaccagttctttgggatatggctaggttcccccaacccctcttcccctgcctgagccctggcaccacataccgcaaggaggggatgcaagccaggttctcaatttgctggatcttattctgcaagaagaaaccgaagtggggaaaccaagctgagatcagatgcgtcaggggccctttacggggacaaagccccaagaccatgtctactctgcagctggagatctggcactttgggaatgatcaccccactccttgaacaggttgccactaccttaagaaagatgattttctttccccatgtggatggttaagggtgtaaacctggggtatctaaacctgactacgtatactcttctgattccacaaccaaagagtgacctgggaatcagaaaaggaaactaagaagccaccaggaaaacggaaagggccttggtggtggcttgcatacacagagagaacaatgagcatacaggaacttgacggttaaagtttctatggggaaagttgaagcgagctgggaatactcaaccaggggaaggctgaagatcaaccaaccaccaccaccaccaccaaacagccttcaagtaggatctgaatgatgtacaggaatcttcatagtttcctcttcttcaaaacaggaaatgggctggagctatttaacgtgaaagatttagagtagatgccaaaaagaacttctagatcaagagaagtgcctaaagaacagtggaaggagcacaggtcatgttcaggatctattttgagggaattagtttttcaattcaggaccctatgtcattcgtctgggaatggtttaaatgaaggtctgcctgcctgaacaccagggaatgggcaggatgacctggttggctcctttcagatgagacagattaggtccacaggggtcaaggggaggggaagggtggagaaagaagttaccccttgcagatagagactgtgaagattctggaggccttctaagttcctgatagtagtaatcccctcccggtccaggcggacagtctgcagttcatcaagagtgtgaaacctgggaaaagagtcagtaagggtggtgttagagcaccactcatgtggtctcttagcagggaggatgggagacggaggagggaaggggtttcaaggaggggtagttggctgagtcattttaatcagatgtgagaaacatcttgacatcttgaggtggtgtctagatcatgaaaccggcttgacttgcagactcgtatctctattgttagcactgggaagggtgagagagaggagtaagggccctctgggaaattgggggatggcagcttatggtttctggagagattcagaggcaagagaaaccttcctctggccagcttggatggtggaggcaggggtgggacagagatgagacactgcagaaagatccttcctcaccttccttttgagtcgttcatggagaaaaaagcacttgttccatccacccattcattcattccacaacattgctgagtgcctactagagacaaatgacagagtctctgcccaccactaataaagaagcagggcaggctgaccatggtggcttaccctgtactcccagcactttgggaggccgaggcaggaggatcgctcgagcccaggaggtcgaggctgcagtgtgccatgattatgccactgcacttcagcctgggtgacagagcaagaccctatgtcataaaaaaaaaaaaaaaagaggctgggcgaggtggctcactgtaatcccagcactttgggaggtcgaggtgggtggattgcctgaggtcaggagttcaagaccagcctggctaacatggtgaaaccccatctctactaaaaatacaaaaaaaattagccgggtgtggtggcgcacacctgtagtcccagctactcgggaggctgaggctggagaatcgcttcaactcaggaggcagacgttgcagtgagccgagatcacaccattgcactccagcctgcgcaacagagtgagactccgtctcaaaaaaaaaaaaaaaaaataggaagaaggccaaacatctatgacaagtggataacagaggcaagtacaggggaaaggaagaaggaggaggaagaagggaaagaaggaggaagaggaagaagaaagaaagaaagaaagaataaggccaaacatccctgacaagtggataacagaagcaagtacaggggacaaagggagtacataggctgtgcactaaattcacagtaggaggaatcagggaatgcttcctagaggaggtgacagatgagtaggcattagccatgaaggtggggggatatggggagaaggcatttcaagcagaaggaatagtacatgctaatacagcccttccgaaactccaatatgcccatgcagattctaattcagtagatcgggtggaggggctgagatgctccacttctaacaagccccctgtgatgccaatgctgctgtcctacccctgcaccccctcccatccacacatactctgagtagtaaggtactaaggtgtgagtacacagtgtgggaaattgtacacttgtggagagtggccagaaataaggctgaaaagcagaagtcaactcatgcttaggcattgggatttatttgggaggaagtttctatcagtgaatgcctgattagatttgttatttaaaaggatcactttggctactcaggaggctgaagtgggaggattgtttgaggagttcaagaccagtctggccaacagagcaagaccccatctctaaaaaagtaattaaaaatactttactttttgtttgttttagaaatagggtctcaccctgttgcccaggctggcatgcaatggcatgatcatagcttactgcagccacaggtacctgggttcaagtgatcctcctgtctcagccacctaggactacaggtgtgcaccaccatgctcagctagtttatttttattttttagagataggattctgtctctattgcccaggctggtctcaaactcctgggctcaagtgatcctcctgcctcagcctcccaaagtggtgggtgtgtaggagagaggtgaacacggccttatctaagacagttgagtgaggatggtgaaaaagaaatggaattattttgaagaagggaaaatcagctgggcattaccactgattgaatgtgtggagtaaggagagaaacaaagatcagttgacaaatcagtacacgtcagggacctggtcatcctgagtgtttcagccttctagcaccccttttctcccccatgcactcacatcttctctgacagttccccatcttcagggaaagtcaagttccgcttagtgataagggcttcagtgatgcagacgcccccttcctctggaccctgggctgacttccctgtgaaaagatgagtccaactgtgacacttcctcactcttggaggccttaccccgctgttttccaactgctctacccaccgtcccacctccctactcacctccagacatgatctaaaataaaaggctgctggtctgaggcgggagaggaacgaaaagagaggtcttggcggcccctaaggatggcagaactcaggatggcaggaggagagagaaactcagagacttaggagaggaggaaagggggttgattcagagaaaattgctggggtgaggtcgaagaaaacagtaaattgatgtgaagggtctggagtttgaggggtgtggaggggctttgctggcagcaagctggggtgttgtgggcaggaatggttgagaaaggagcagttcctaggaagccggagtcgttgctaagagactggacgccgagtggggaggtaaaggcgggctccgttggcccgg

SEQ ID NO: 1900 - DNA, 3008 bp, Homo sapiens
ggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcatgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttgggaggctgaggcaggagaatcgcttgaacccgggaggtaaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccaaccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggtgagaagcccgtggctgcagagtcacgcctggcagcagcacacccctccctccacactcatggattcctcagagaagactggcttaatttgtggcccacgtcccagccaatctctgtaaaatcactgagctgcagcacagggggcccagaatggggaggggacttggccatagttccatagccagttgccctctcctattgcgtttaagggatgatgtggtcaccagggaggaccaggcagggattcagagggcggggttctacatttggttccaaatttgaggcatttaacttctcaaagctctgtttctccatctctgaagctgatagggaggtgttacctgtcttgcttgcttcacagggttggtaagattaaaagaagtccctgtattgaggcacttagcgaagtctaaattgtaaaaaagatggcgctggtatctagctccacaaaagggtgagcccttatcctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgc

SEQ ID NO: 1901 - DNA, 282 bp, Homo sapiens
gaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgcggtcccaactgtctctttcctaacagctccccaggcacccacacttttctgcctctttttcaatctgtacccttgaccctcctcctttttctgctttgtca

SEQ ID NO: 1902 - DNA, 776 bp, Homo sapiens
  misc_feature (709)..(709): n equals a,t,g, or c
  misc_feature (738)..(738): n equals a,t,g, or c
tacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgactgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgccaaaggaagagtatgagtattcaacatttccgtgtcgcccttattccctttattgcggcattgagcctgtctgtttttgctcacccagaaacgctggtgaaagtaaaagatgctgaagatcagttgggtgcacgagtggngtacatcgaactggatctcaacagcggtnagatcctcgagaggtttcgcccccgaagaacgtttttc

SEQ ID NO: 1903 - DNA, 878 bp, Homo sapiens
  misc_feature (741)..(741): n equals a,t,g, or c
gaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaaacgctgtgaaaagtaaagatgctgaagatcagttgggtgcacgagtgggttacatcgaactggatctcaacagcggtaaaaaccttgagagttttcgnccccgagaacgtttttcaatgatgagcacttttaaagttctgctatgtggcgcggtattaatccctatttacgcccgggcagaagcactcggtcgccggatacactattctagaatgacttggttgagtactaacca

SEQ ID NO: 1904 - DNA, 150 bp, Homo sapiens
cgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcgg

SEQ ID NO: 1905 - DNA, 25211 bp, Homo sapiens
  misc_feature (15723)..(15724): n equals a,t,g, or c
gagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggtgcgggtgtaggggtgggaggccggggcgaacccgcagccgggacggtgcggtgctgtttcctctcgggcctcagtttccccccatgtaagagaggaagtggagtgcaggtcgccgagggctcttcgcttggcacgatcttgaggactgcaggcaaggcggcgggggaggacgggtagtggggagcacggtggagagcggggacggccggctctttggggacttgctggggcgtgcggctgcgctattcagtgggaaggttcgcggggttgggagacccggaggccgaggaagggcgagcagagcactgccaggatatcctgcccagatttcccagtttctgcctcgccgcggcacaggtgggtgaaggagtgaatgcctggaacgtactgggaactgcaccaggcacagagaaagcgggcttgccattatagtgggttccgatttggtttggaaaacatgggcagcggagggtggagggcctggagagaaggccctacccgagacaggggcggggtgggaaggacggcagatgctgggagcacgaggcaatttctttatgacacagaactcatgctctagtattccatctgtttcagccgaagaaaagaaccagctgaaggggcaggggagaaggggcggaggtattctcgaggcccattggcgtcctttaggactcaggcagggaagggcccttggtgctctggagccggaggtggtgcgcctggtactgggaccccggagctgagcccggcgcctcagcccacctggctgtctgccgaccgtgtgcggggcgagtttgctcaacaactctgccagcttctggccctcaggctgtgggaagcttcttcccggggcgagaccactagctttttctaagtattaccagcccaggacttggctgaggttctgtgtcccccagcttggagtcagatgtggggttgaatcttggcttcctctcactagctgtggtgcttgacaagtcacttatccttgagcctccattgcctaatctttaaaagggaggtgacaatcgtccctacggctcagtggcagcagatggggagatgaagggaaagttctgttgaccatgagtgaacttacaatgcaagccccggggggatcacttgcagttttgtccctgtctgcagtgtgacctgttggtgacattgtctttgctccaaaccacagctcctggggcagaggggaaaattctgccactcacagctgcctgcccacgcttctgtctgagtgtgctgggtggcaggatggcaagtccttactcagctcagtatagccctcttccttgttccctgagcctttgactttctcgagggatgttgtggggttgtggccaggataagaaagggcatttcaagttaccactgctccaaaacaactgttctggaaatagtgagtaccccatcctgagaggtgagtaagcagaggctgtatgaccacctgaaccaagcccttgaggatgtttcttctctggtggaagtttggaacaggagcctcctcaagttcatttattcattcattcaatggttattttgtgggaatcgaatttagaatgaaaatattttttggcaagcagaaaataatttttagaccaatccttttcttttagtcatgagaaactgaggcccagagagaggaggtcaccccaggtgcattagaactgggtttccagaactgacactccactgcacagagtactctcccaattcattcaatttttatttagcggaaggcattttcagatgggtctttgaagcattagtaggagttcagcgatgatggtgtcatgagaattttattctaggattaggaggtaccatgaacaaagatacagagctgggaaaaccagaggtggaagataaggagcacatgtccacagttctttttcttttttttttgagatggagtttcgctcttgttgcccaggctggagtgcaatggtgcagtctcagctcactgcaacatctgtctcccgggttcaagtggttctcctgcctcagcctcccaagaagctgggattacaggtacctgccaccacgcccggctaatttttgtatttttagtagagaaggggtttcaccacgttggccaggctagtcgcaaactcctgacctcctcagtggatccgaggaggtgatcctcccgcctcagcctcccaaagtgctcgaattacaggtgtgagccaccacgcctggcctccacagttctttatccaccgtctgaaatgtaaaatgttacgaaaaccaaaagttttttttgtgatttatttgatggtagcacctgacgtgaactgacatgagattatttttaatttagttgtgtgaatatgcatattcatatattttgctgcatagattacagtatgcagctccagattcttccaagcagactctgattgcccattactgcctttctaaaatccaaacaagttctgaggttcaaaaccgatttggccctaaggctttgggtaaagggggtggactctgttctactctgactggagtccaagatgcatatatacagagatatgggtgatggggctgcaaggtaggttgaggtaggggccaaggaggagcatggagtttggacttgattcatgaggctgtggggagccagtgaaggttcttaagcaggtatgtctgcctgagagcagttggagcagacaagagctaaaaaccaaacaaatcaccatagatagtggctgctataatttgtttgtcccctccaaatctcatgtggaaatttggtcctcagtgttggaagtggggcctaatgggaggtgtttgggtcatgggggaggaacccctgtgaaaggcttggtgccgtccttgtgataatgagtaagttctcccgctatgatttcccttgaaggctgattattaaaaagagcttggcacctccctctcttctctcttgcttcttctcttgccatgtgattgatctctgcacatgtaggctccccttcaccttctgccatcagtgaaagcagcttaaggccctcaccagaagcagatgctggtgccatgcttcctggagagcttgcagaatcatgagctgaataaatcccttttccttgtaaattactcaccttcaggtattcctttatatagcaacacaaaaggactaagacagtggccttgacttttctctctctttaagaagtgttgcctttgctcacttagtcatcccttctgcctgcatttgtagagcatctggatgggagatttatataaccgtcactcttgactttcccagcaggcctatgtcataggtactgtggtctctacaatacagcagaggtatctgaggctccgagaggttgagtgacttgctcatggctgcacaaccagtaaatattggagctggaattcaggtccacggtttcctggctccaaagcccatgattttttccctcaatttattctgactggggcatgggggagggggtggcctttgggcagggccaccaggagcgaccaggcccgtagagagctgggtgcaggtacagaggaaaacctgttgtcgagtgtggcccgtagttcccatttttgcctgaatggcacatttgaaagtgttatataaccatgtgaataataatagttggcctatatgagttttttaatttgctttttggtccgcatttggtaacttctttatcatctactatactctgttgtgtctcttttgttgtaatttgtaagtaggggtgagataaagtacacctagggtttgctgggtttcttccatgtcatcatgttcctccttgcatggggccaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggtgagccaccctttttgggaatggcacttcctgatagggctgggccactgcatatacactggggactgtgcttagtaggcccattgctgaaaatcagaaggggacagcaagtatgtattgagcacttatcgggtaccaagcacagtaactactggctttctgtatagaattccctttaagcctggccatgccccagtggtacgtctatcttcatttgaaagacgaggagactgaagttcagaggggaccacacagacagctaggggtagagcctggatcaaacccattggtctgcctgccagccattcttgtgccaatgcatctgctgcctacggaaacctgtagggacaaggccctgggatgttcagtggagcctgagtcattttataaaaaagcatgactctagggtccaaaattcctttgaagctgttgctatccagagtgaagtcccttctttaggacagggtggccctcctccctcctggatgtcacatcttcggtggaggggcagaaaggggactgggtattctcctcaccctggccctagtgcttcaaatcttaaaaaaacgtttttatttgtgcttctgcaccaccttctagcccacctcgtttcctggcctctaacttgatgagagcgtgtgtcattttcacactgattctccacatggcaggcggtgcttcttagcctcctgcagacagtgaggccccacggtcttgtccaaggtcacacagcgtgtaatgggcagggtcagagtctggagtctggacctgggtctcctagctgcactgcactgctgccccatgggttaatcagctcagcataccgtggctgaacagctacctcataccaaggcctgtggcgccatgacagggattgacagggtccctgccttggaaacccgtagtctaagtagaggagactgacaagtcaatgccttccatcagtctgctcaacacacgtttaccaagtgcctactgtgtgctgcagaggcgaagatgacacagctcaggcctttcccttgagcttacagttcaggaggagagactgaccagtgactgccagtacagttgactatgggacaatgtgctcagccttggggagagacgaagaaggtacccgtatagcaccagatgacaggcacgagccccacaggccagggcagctgctcagaggagagtaggccaagcagaaggcaaacagaaggctgcaggcatttgccatcgagagctggacttcaaactgggcatcataccagcctgggttcgagtcctgcccagccccttattggctgtctaaccctgagcaaatcccttcacctctctgagcctcattcctctatctgtaaaccagttataataattggaacattcatttaaggactaaatgaggtcgtgaagcattcagcagatgctaggtacggaaactcgctgaagtgggggcaggttaagaagcctctggggatacgaaggcatccagggactagttgtggcaggaggctgttaccacttaggtctgaagggtaaggagagggaatagctttccctctgcccagttggagccggtggcatggaggagaggctgcctgtggggaatcacccgagggttcaccgctgccatgcgcagggagtcaggaggtagggagggagtggggcagatgcacaccatttttttttttttttgagactctgttgcccagactggagtgcagtggtgccatatctgcacctctgcctcccgggttcaagctcactgcaacctctgcctcccgggttcaagcgattctcctgcctcagcctcccgagtagctgggactacaggtgtgtgccaccatgcctggctaatttttgtatttttaatagagatggggtttcaccatgttggccaggctggtctcgaactctcgacctcaggtgatcccccacctcggcctcccaaagtgctgggattacaggcgtgagtcaccgctcccagctgctgatgcactcttgtccttctaactcctgctagtgcctcccattggctgagcccaactggaagctttgcaagggagctggtgctgcagtttgcactgagcaggctggagaaggctggagaatagactaggggacaaaccgaattgccagtgctgttatgtcatgatttaggcatggagtccagggcctgagcttcactccatgtccatcctgcccagagccttggcacagcctggctcccagacaagatgtcaagttcagaatccttcctaaaaggaatcctctatgccagaccgtgttgcagggatatgggggtgctgggctcccagcctgatcaaggagcgagaaaactcaggctcctagtctgtcctccggggcactagcagggacaaggtgggaggctgctgggctgggatgtggggacaggtttgatcaggtaaggccaggctgtggctgtgtttgctgctgtccaaatggcttaagcagagtcccccggcctctctggcttctgcaggccttgaagttgccccatgtcgactacatcgaggaggactcctctgtctttgcccagagcatcccgtggaacctggagcggattacccctccacggtaccgggcggatgaataccagccccccggtaagacccccatctgtgccctgccccaccccatctgagctgaatccatttgctctgccctggcctggcctccctgctggtggtttccacttctcggggggctttgggactcagcacctccactgacccctttttttctgtcccatccccatcccctgcagcccccactgcctgccttcctgttgccccacaaatgcaaaagtcttgccttaaatgatcctcttttcctccttttctcttgttttccttttctcaccatttggaatggcccagcaggctgcacttaccttggaaggagggttcatctgatggtgactctacctagggcccccaggcctctataactcccagtgccctgcagactggaccagatcctttaatgggatagacacaaccctgtctgggatgcctctgcctaccttcctgttttgctgctccacctgcctccagctccgtttggcttcctggggctccctgcctgggccactttgtgtcttccctctaggcctttctttccactgttccctctgcctggtgtggcctggctatggaagggagggagcaggagcggccatggaaaacggtctgcattctagcagggacttgcaggtggcaattcagtcggggaagactctagatgcacctggcctgaggagagaatgaagggttctagttggactgtgttaagtttgaggtgcccatggtgtgaggtctggagctcagcgcagagatgatgcaatgtggtgggtccatgcaacatggtgccaggacgcagagcttggggtgaactcagctttcaccccttaccggttctcgtgggatcttgggaagccactttcttctatgagctttgtcgttcttgtctgtaaaatgggcacataaccctgtccctgtccttctcacaggttgctgtgagactccaatgagttgaaggatgtgcagatgcttttggaagtgaaaagttggggggctactgtgtgactttgcatacacccaaactgtgtgaccttgcatatgtctgagttgctgccattgcaacagatcagagctggtgggctgggtgtggagaaagggtttgtgtgggggacatcctctggcaagggtggcagcagcagaagtgaggggcctggtcggtcatgtgtgctgacccggcctgggcagcctgtggccagggagaggacagctcctctgtaggaagagcgtgttcctttccaaccaggtgagacctcttcagtggagccctggagccccctgtactccacatcagtgcctcagggacctcccggagcaggctaatatcagagaccaagagggacactggcagaggatcacagagaccccagtccaggcagggactgagaagatcttgccccctaagttagtttcctagcactgctgtgacaaaataccaccccctcggttggaacaagttgattctctgcagtcctggaggccagaagcctgaatcagtgtcggcaggaccactttctcccggggggctccagggagaagcttctcttgcctcttccgtgtcccaacagcggcagcacaccaatcccagcctctgtcttcacacagccttctctgtgtctctctcctcttcattgtctcataaggacacttgtcattggatttagggcccactggatcctccaggatgatctcatgtggggaaccttaaccacatctgcaaggaccctttttccaaataaggtcacagccacagtttgtgggggttaggatgtgagtgtatctctttggcagccactgttccctcctctcccttgggccagaagcagacgtggggccctttcttccccataggatgcccatggattgccccccttcccgcttcccccgagcgtctgtgggaggtggcaggaatggcaggcaggtgtgtggaaccccttctggagtcatatcaagggcttggctggaggaagtcctcctggagctgttgggctggcatggggcaggctggctgggcccagcagcagcttcttcattcatggggaggccacaagcatgggccctagagctggctgccgccctcaaacccagaccctgcactcttaactgtgtgaccttgcatacgtcactcaccctctctgatcttcaggttcctctgcaaaagggaggtaatgataaccctcactctggggggctgtttggagggttaaatcagttattgctgtagcatgcatttctctgtcaggtattgagtgaggtgctgtgattttagccctgcatttttcttttcttaccattcaataataacgttttgagcaccctctgtgcgccaggcaccatattaggtgctggggatacaaatgtgaatgaaatgaatgtggtctctttccccaacagtgtatccagaagattaatccattccttaaacaaatgctacttgacacagattagttctggataggctgagagctctgaaggagtgcaggcagctgcgagcctgtgtatccagcagaaggatcaggaaaggattcctggaggaagcgctgttctagccaagacctacgggggcattattaaccaggcaaaggggacggtgtccaagcagtggaatgaacgtggattgaagctgtgaggcaggagggagtgtggcctgtgcagaagggaccgaggctggtgagaccagcagggcctgggtggcctccaggtcagatgtgaaaggaagaacttggccacagtctgagcttctcaggcgtatggcagggctgcctggtgagagggaatgagctccctgctctggaggtatgcaagcaggactgggctctcacctgccagaggccacagagctttccagaggctggaagaggccactccaaggcctctttgcccctgagagtggtggctcttcttgaggccaccttgccacgctgtcacagggaactagcagcccctgcctcacccgggggtttggaagatagagggaggcctaggaagggccctgtgtctcatccgagctgggcccctttccagcctctcactggaaggaagcccaaggatgttcctgtgggggcttttaccaggcccacctgccctctgctggccatgcttgcagcctcctgaccctgtcccagcaggacagtgggctggtgtgagcgggcaggaaccgcctgcacttagaaggtgtggggctgcctccccgagcttccatctgccgctggggccacaccccaggcccagggatgggaccccatagtggtcacatcatcttgcagcagaacccaggtacagctcctggagcagatggtggtcccaagcacgggtgggaccagaaaggactctcacctgggctaactcagctgcagcctcagttccctcctcacacacgaggaacatggactggaagcctgcccagcaggccttctgctcgatgtgcgttgtgtggcttacgtccagggagggaagcagcctctgtgctgtcttctagataagcctgtattccccgggctgtctgccaatgtatccagttgtcccgtcagcctggaagctctgagggaaaaccttgggctgcttcctgagcacctgtatcccctgcagccagcccggggcctctgctaggagcagactgagcatggcttatgggcctggcaccatctggcctctgcccaccttgctggccttgtcttgtgtctgccccttcgacattccatagcccagctcaatatctagtggttcctctagggtggcgagcactgtttggtctccagatgtcttcaggtcggagctcacagcgctctcagccaccccttcccagtgtagcaccgggcacatggtagatgcctattgatgagtgaaagctcctaacacactcagagagcaaggactccgcctcatcccacagcctgggaggagaggcagactgccaaggacctgctcagcatgctacagaagaaaccaaagtgcccacgggactgatcagtggagcttcctgccgagactggaggccttagggcagggtagacagtgtgtgtgcaggctggggactcacagttcggactgtgcccagacctactagcatagtgggtgggtgggaggatgcgggactgggggccgaccttgcctgaaattcatgtgggatctcagagcagccactgaattgctctgtagggggctaaatagtggcccccacagatacacacacccagacagagcctgtgagccagaccttatttggagaaaaggtctttgtagatgtaattaagcatctcaagatggcatcatctggattatgcggtgggctgtaagtcctgtgatgtgtctttatgagagaaaggcagagggagatttgacacacacaggaggggccacgtggagacagaggtggagattggagaaatgtggccacaagccagggaacaccagcagccaccagaagccggaagacgtgaggcagggttcttcccagagccttcgctgctgagtctgggaatttgttaccgaagccataagaagtgggtacacgccctgagcctcccacacttgctcacctgtcctgagatgagaatctctactctgcagcatatttggaggatcactgcgggggccacagaggtgctgttcagatggcacttcagaagactcaggagaccctggggcaggagcagtttgactgacagcccagagggctgccctctgattccacctgaggccctgcttttcctggctgcaggggttccagggccaggccatttccgctggcgcaggactctgctagcagcaacctgcctgaagtcttcctttggcctggctgagagtttctgagacctgcgctggagcggaggtgcttccttccttgcttcctttcttcctctctcccttctccatccagcaggctggacctgcctggcatctgtgagctctccctactttctcctataccctaacctttgtcctgcatgggcgactcccccagtgagtctcttgcagcttttaccccagtgcctgcttcttggagaatccaaactgatccagttagggatgataaagtgtagggtaggtgctcggtgactgttttctctgaggttgtgactcgtgtgaggcagaagcagtccccgtgagccctcctggtatcttgtggagtggagaacgcttggacctggagccaggaggcccagacatacatcctgtccgagctgcagcttcctgtctctaaaatgagccggccagcgcaggtggccagacatcactgttattctcctttgagtctttaaatcttgttgtctttcttgcagactcggtgagctgtgaaaggctataataggggctttattttacactttgatactattttttgaacattcatattattgttagatattgatattcatatgaaggagcaggatgacttgggtccttcttggcagtagcattgccagctgatggccttggacagttacctgccctctctaggcctccctttccttgtctatgaaatacattatagaataggatgtagtgtgtgaggattttttggaggttaaacgagtgaatatatttaaggcgctttcaccagtggctgggatgtgctctgtagtttgtgtgtgttaactataaggttgactttatgctcattccctcctctcccacaaatgtcgccttggaaagacggaggcagcctggtggaggtgtatctcctagacaccagcatacagagtgaccaccgggaaatcgagggcagggtcatggtcaccgacttcgagaatgtgcccgaggaggacgggacccgcttccacagacaggtaagcacggccgtctgatgggagggctgcctctgcccatatccccatcctggaggtgggtggggactgccaccccagagcattgcagctgtactcctgggttgcacccccccagctgtcactgtcccctccctgccatcagttgtgggaagggcgttcatccatccagccacctgctgatttgttatagggtggagggggggtctttctcatgtggtccttgtgttcgtcgagcaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggtaagtgatggccccagacgctggtctctctccatctggacctggcctgggaggtggcttgggatgggcccagggagagctaatgtctcctaaccaagaatgctgtggcagcctctgccgcagagccagagaaccagagtgccaaggctggcagggttcccagtggccacgagtgcagatgaagaaacccaggccccaagagggtcatgcaggtagcccagggagttcagccttgaccctgggtcaatgacctttccacagttccacactgctccccttttaaaatccggtgatgtctttatgtcttttgttatgttatcttcaatgtggagggactcgaggtgatctaagcaaactttttctatcttctgcttgcatacctctgagaccaggggactcactcacttgcatgactgggccctgcaggtcacactggccaggcagatgtggtggaggaactggcagaggactttttctagactgtgactacatttagtccacccagcggcccccctatgaagtccagttgagaactaggactctgggggcctgtggacagagaagagggagggttctctcccttactgacttccttctgtggccagacattgagcaaggcctctgtacagcatgtcctggggctggccttgccgtagctgctaaatagttgacgaaaccagtccagagaggggaggtgactgccagggtcacacagctcaagctggggaactcgctgggaaaactgtcagctctgggcagcagcttgacttccattgtaagccccagcccccagggtcaaacactggctctggtgctggcagaggcagcccactagcctgtttcaaaggctgagaaggcccaggagtctgccctgtgctccaccagttctgccctgagactttcctacagagtacaggttttgatgttcagttttaaaggcaagaatcaataaccttctgccccatcaggtgaccccttgtgcctgtcccacccctttattgactgacctcggctcagtcaggtcagttcctgaaggtcagtgtgtggaggggaggctgttctttcccagaaaggccttccccaggcctggtgctctggcctctggaggacttcctggagaagtcccttctttggggtcccagtcagtgtatgggaagcccttattgcatgacctggcacggggtaggggctcaacagtcactattgccttccttgccactgccatttcctcctctgtaagcaggtgattgtgtgtccagtctgagcacagagataagcacacagcaggtgcttaataactagcagctgtaggctgggcgcggtggctcatgcctgtaatcccagcactttgggaggccgaggtgggcagatcacctgaggtcaggagttcgagaccagcctgttcaacatggtgaaaccccgtctctactaaaaatacaaaaattagccaggcatggtggtgggtgtctgtatcccagctacttgggaggctaaggcaggagaatcgcttgaacccaggaggtggaggttgcagtgagctgagatcgtgccactgcaatccagcctgagtgatagagcgagattccatctcaaaaataaataagtaaataactagcagctgtaaatgtggctgttgttcttcacctccacactcagtgccactccactccctccctccgtggtgtgaggggcctcactagctgtctcctaggaggagcatggctgtgagattccagctccatccttgaccacggctcctggagacatcttagaggccaggatccagaaggctcccacaccccatttgacaggggagaagctgtcagttccaggtccccttgcacatcagggccagagctgcgttaggcctccagtctccaggccactgggccagagctcacaggctggcagagggttagaactgttactggtggctgggtgcactggctcacgcctgtaatcttagcactttgggagggcaaggcgggaggatcatgaggtcaggacatcgagaccatccttgctaacacggtgaagccccgtctctactaaaactacaaaaaattagccgggcgtggtggcaggcgcctgtagtcccagctactcaggaggctgaggcaggagaatggcgtgaacccgggaggcggagcttgcagtgagccgagattgcgccactgcactccagcctgggcaatagagcgagactccgtctggaaagaaaaaaaaaaaaagagctgttactgttgacagtagcatgaggtagaccatggcctgcaccaaaagggggagtggagtgccactgaggccagaaggaaccacaccctcaagggtggggagttatggtagggggggtcctaggcatggagtcttttattctttagacaatcctgggagcagctgtccctgttcacagagggcggggccacacagctggtgagtgggcagccaagactctgttcaagtttgtgtgggtccaacacttgcggccacggtggaggggcatctgagccaggcctcagagagtggcggggggaagttgggtggggaagtgtnngccttctcattcctctgaggctcatcctcttggtgcctctctttcatggaaagggataataaggttattgtgaggatcccctgagttcatatattcagacgcttagacagagccaggcacagagaagggcccggggttggctagtttgattgctggtgtaattgctaatatcttccagtttgtattggtcaaggttctgcagagaagcagaaccagtaggaggtatatattaagagtttcaagctcatgtgaccgtgcgggctggcaagtctgaaatccgcagggcaggccatgcaggctggcaattcctgcagaatttgatgttgcaatactgagtcctaaggcagtcctggggcagaattccttcttccctgggaggcctcagtctgttctcttaaggccttcaactgattaaatgaggcctgcccaagttatagagagtaacctgccttactccgtcttctgatttaaatgttagtcacatctaaaaaatattttcgcagcagcatttccactggcttttgaccaaacatcaggccacaaagttgatccccaaaattaaccatcactctgtgcctgtaagggaggggctgggaaaggggagcaggtctccccaaggggtgaccttggctttgttcctcccaggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtaggtgctggggctgctgccccaaggcgcgggtagggggcggagggcggagggagggcgggcgggcaggcgggcttcttgtggcacgtgggcttcttgtggcacgttcctggaggccgaacccttctggctttggaaggagtcgtcagagacccccgccatgcgggaggctggggaggaaggggctcgaaacctccatcatcgcagagtctgaatagcagtggccccgccatgcgcccacgtagcggcgcctacgtagccacgcccccacgccccgtcctggccactctccctcctgaaggtcttctggtacccgccccctccccatctccatccccaggccctgcgtcctctgcccaatactctttgggcctccctgttgtccagctctctccgcggctccatgactgacaacttgagcaaggctaatgtgaatgggagcggttgagggctcagacctctcacccgaggaacatccacagagtgtgccgcatgcccggtgcagtgtggctgcggggacacagacacggagcctcggccctgaggagctggggggcagtgaccgtccctcctctgacccaccactcctccagtgtcaggacactgcgggtatctaggggaaggaatcttgttccacttcaagtctggaacttcaagtctgtgtgtgtgcgtgcgcgcgcgcgcgttgggggtgggggttgcagagcagatgcgtacctgacagcggtaacctaggtccccccggcctatcaaggcttccctggcggccgaatttaaaggcatcaagcaaacaaagcccaacacatctctgccttgtcctctcagtttccccccgtggcacttagaaccacttgatacaccgaatagtttccggtctatctcccccactaggatgtaaactccacaggggcattgggaatgctgcctggctatggtagggacagaggggagcaccagggcggggcaggggtgccagagttctgcctgggcagtcagattttccttaggaggggacatttgagtgggacccaaacaggtgtatagcagttgtccagcccagctggcaaggcctgagtctgcctctgcaacccctctcttgggctcctttctctgccacccacctcctcacctttccaggtcatcacagttggggccaccaatgcccaggaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggtaagtcaccaccccactgcctcggccaccgtgatgctaacagcccctttggcagtcagggtctgtgccgggacctccagtgccaggctctgtgcagggggaccagagatgaagtaggcctgatggtgccttcaaggacactcagtctgatgagggaggcgagtgcacagagggaacacgaggtcagggctgtattagagggagcccagaggaggcacctgcccagcccgagggtcagagaaggcatcttggaggagggacatttgatcgggagcttgatggatgaataggagtttacctggccgataagacagcaactaccaaggcttagaggtgtgagaggaggctgtcttacctcactgagtaaggactgcaggcggcttaccttcgagaagagagcttagtgtctgtgtgcacgtgtgtttgtgtgtatgtgtgtgcgtgtgtgcactggcaggagtcccctgctggggcaggagggccgggccatcaccatctttcaccattcacccctgcaccaggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggtaagcaggatggcagggtgggcaagtccaggctggggcttgggaggtctgtgtgaccttgacagtctctcccttctcccttgtctgtgtaaggaggatgatgccaccttaaataggattaaatgagaatggggctctgaaagggctgtgcaatattttcataacgtgtttttatagagacagttgagtatgttctttaagccctcctctctcctaccatgaactaaagatttttgtggaggtcccctcactcccagcaccccctcctcatcccaggccctttttgcaggttggcagctgttttgcaggactgtgtggtcagcacactcggggcctacacggatggccacagccatcgcccgctgcgccccagatgaggagctgctgagctgctccagtttctccaggagtgggaagcggcggggcgagcgcatggaggtgactgtacccctccttcgtgtgtgtgtgtgtgtgtgtgtgtgtgtgtgtgcgtgtcagtgctgggccctcagggacccccagcaagcccctccatcctccagactccagctcttctgtaagcttacagggctggccagaccaggagtggggcactcctcacttcacgcggctgggggctgctggagagagccacagcgggaagggtttcctagaggctgcaggacagtgctggatggattttcaatgctcacctgggtgtgagcatgcggcagggccgcgtgagggtcagcgatctgctactctggactcagccatctctaggcccctctcactcaggtgctccatggttctgggagctgagaaatctcaaaccagcaaaaaagtggaattgatgttgatgctacaggatagtgcacagatgccatctggttgcagcattttggtggaagggcagtgcccagctaggagagtgaggaggggcaggcatttctggcttgaggagatagggtcttaatgctcgtgtgagaggcagagtgggtggagtggagctggctggatccttgctttggcctcctggatttctctctatctccattttgaaaccactctgtgtttggaagaacttttgagtattcagagctgcccactggcagaacagtcttccttgggcaggagtgagctccttgtccccagaaggctgggtctggctggcccctggcagggacactgatgagggtgcttgagttgatcctgtctagtccctttctgtgttttcaaagcccattctaaagcagattcccatttccgtctttgactctaaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggtaggaggctgggcttgccctggggtgaggaggggtctctttctccttatgcacccactgcccacgaggcttggtcctcacaagtgtgatccatgagactcaagcctgacttgcagttccatactctggttctgccacttccatgccctttgagcctgggcaggtgaccttacttctcctcatctcagcttcctcctccataagagggaaaaaggtattacctgcctcattgtgttgcaaggagatgggcagcatctagggcactggcctggagtatcgcaggtgctttgcctaaggtggtgcagtccaggagaggcagctccagagagaggcccccggctggggctgaaaggagggcagacctcggtttgaatttcaccctgccgctcgatagctgtgtgacttgggcaaattacttaacatctctgtatgaggaaatgatgagtgctaagcacttagcttagtgccgggacaatataaattctagctatcgttactattgttttcatcacccgttgctttaaaatccagtctctggtataggcaactattgacgggctaccctgtgtcgaaaacatgcccaggcaggtagcaggaagtcacagatggggacctcttggggcatcaagggatggtgccctgaggctgagctgttctggttgggtggagcatgagaggtctgggaagacagtgggactccagcctggaataagaggctcagagttgattctcgtctgagcacgtccaggggaaccactgagggtttgggaacaggagagtgagggtgagaacctggttctgggcacagcaggctggcatgtaggatggatgttcaggaaagatgagcatagtcaggtggctggtgcccttgtccaggggagaggctccgtcaggttcaggggtcctggcttggagggaagtccgccatgctctaatcacgctcccctttggaagtgctcggccgatgagctcacaggcacatgtcagtttgaagtcatggaatctgactccatgaagcgcacctcaaagagcaccattttgcagctaagggaactgcaggctggacatgctgagtggctgccccgagcccttgcagctaggacatagagaatgctagtaaccacaaccctaccatgttcagagcacatgccaggctccatgctggggcttcgcacgtgtcatcttcacagtgtccctgtgagtaggtgtggtttctctttccatcttacaaatgagtaaacagagcctcagtgtagctaagtaaccactattttaggtttcttagccaatgggtgtgtctgactcctaagcccatggagggcattctgaggtggttcagacagaccccagcttacccttgaacttctgcctgctggctgcatagggaggggctggggggagtttgagcatctcaggccatagagcccctgcctcactgtctccatctctgggtggaaagatggtgttttccctgagaaactaaggctcagagaggttgaatggctctcccaaggtcacacagctggtcagctgcagagttgagaacacaggagtcctggtgctcaggccagcatctctttttttctttgagttgtttctaggtttcctagctcttgcctcagaccttaaagagagagggtctgatggggatgggcactggagacggagcatcccagcatttcacatctgagctggctttcctctgccccaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaagaggcccgtgaggccgggtgggtggggtgctgcgtgtctctcctgcacagcttttctgtgtcagtttgtgccaccaccataccgccatacatcagggtggcggtttgccaggtagatgctgtgggcagcttccgccattgtgtggacagcatgtatatgtgtctctgtgtggctgggtctgtttttgcttttgtccagatcagtaaggtttgctacctgggtaccccactccacttggagtagagtgtgcataaatatggcataaagaaatgcaatatgcatgcatttattgattgatctatttttttctgagatggggtcttgctgtgttgcccaggctggtctcaaattcctgggctcaagcaatcctctggtctcagcctccccaagtgttgggattataggcatgagccgctgcacctggcctctctgatctatttaacaaacctgctgggagggtctcagggtcaggagcagcactgggctctgaggacacagagctcactcagccgtgacccagagggggtgcctgagctgcatgctgaaggttgttagcatgaccagcaaggcaagaaaaggccctgccgagattagcaaggcatgtgccaagccctggaatgtgacagccgggccttctagaaacctgagtgtataactctccttaaaagccagtaggagctccttaaaaggcagccctaaggagtccactcttaaatgaactcagagtcagttttaaaatgcaagtctgtgttgattctggtctggatggtgcattcctcgagagcaaaagacagtcttggtcttggatccacttgccctgggtacactgagggctgctaggttccaggtgctcttcctggcactggggagggatacaggcccaagagacatgctgttctccctcctggagcatctattttagtggaggaagacagaaaacaaaccattaatatagagtactgaaaagatgcgatggagaaaactatagcaaggaagggaatggggtgggagagaggtcaggagaggtctcgctgacaaggtggacgaaacaggccatgaggcagagaacatgttccaggcaaagcaaaggcccccaggtggggatgtgcagggagtaccaggaaaccagagaggtgggaatagttatgagatggggggtgcctcagaggggacagggccaagtcaggtgagacctgagggccacagtcagcagtgagctggggccatgcaggggtctggcctcagaggagtgtggtctggcctggatctgaacctctcactgtggcctagctgctgagctgagaagagatgacaaggaccttgggcagaagcagggagactggagggaggcggtggagggtccaggcgttggggcggggctcaggctggagtctgaagggagcctgcaggcctggtgggtggatgtgggtgggagagggggaggatggcaccaaggctcgggcccctggacagatggagttgccattaagtgggatggggcaggctatggggccatcagtttcagagggatgagtttggcactggcatggtaggcatctgtctatctccacggccctcaaaccaggcatgaagcaggagctcacgtgtttggtcagccatggtgcagaaccgcctgggtgggaggtgcggggtgggagatacacggttgtgtcccaaatgggctctgagccagcgagggccgtctgcactttggcctcacagaaggatgtcggagggagaaatgaagtgtgggtgggggtcccgggccacgctagacatgtgctttcttttcctcgggctctggcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgtgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaa

SEQ ID NO: 1906 - DNA, 6501 bp, Homo sapiens
tctgtttttgaaaaatttattttatactcttagaagctaagaactttgccacacatgaaccaaatttagaattaaggttcttccctagtgtatctacttccttttgaaattttataaacaagattttatacacaagaggtagcagaggaaaattccagtctgcttgttccaagctcagaaggtaactgcacacacctcgatgttagcagggaaggtggggcaggacagggtaagtctgatgatacggcactctagttcctaaaactgactgtagttgtcagtgaccgtgtgaggactccaggagaagtcgtggtgagatgcccgctgggatgcttgttttctttcccaggatgccttcaacgggcagaatcggccatcttaagatcggcctcactaagggagcttcttgagaacacacagcattattgagttaattgtgcaattcctgctctgtttgcagaccattttgaaaggtttataaaaacatcttcatccaaaaaattggcagtaaaaatgacaactcttccaaggtaagcctgtcataactgtcactgttgtactacattaaaaaaagtcatcagcaggttcattgactgtagctgtcagcaatcaagtggttaccagcaaagtgaaaacgatggtcattgcagcaacaatataagcaacatgatctgaagcgtataatatacacggtggacgatcctgatgaacctttacagtgaggacggcaggtgctaggggtgcggaaggcgttgtttccataggaaataaggggactagaagtggcaatttcactcctgattttgggctcctgagagtgcagtcgccagcgatgatatcccagtgtggatcatcgccagcatttcaaggtcatgtcccacacaatctcttggtgaggatgtgggcggagagaaggtgagaatagggtaggggaaacagtaggacaggaagtattcacgtactcaaaaccaatggtagaacatcacatttcaaactgcaagaccattggaaccgtctgaagtttgccactcgcctctgtccgtttctctaagggtacagttctgctcttaagtgctggcccttccatcttctcagtgtgtttgacaaaggccactgccaacctccagcaagtcacagaataacaatgaagtctgacagcacagaaaccctcactgccagagaatgaaaagactgggccatggcgagagcacagtaatgagatgccatctgcctggccacatgcccacacaatgccacagcagccagacaggcacttcagggctggctgcgcctctgtgacttggcaaatctgacagtgaaaacctggcacttcctaggctccctagttctgtgcatggtgagatgaaaataaggcaggacctgtaactaaaggcaaaacagggccgaaaatgtgagcaattcaaaatacaaaatgtacaaaatatatatgaaatatgtgggtgtaaacctctcccccacaccataaaagggagctggtataaatgagtgaatggtgctatactttggaaatacgactaaatggatggttattcaattgctttatatttatttctgggaaaataaatcttaaaccttgactgacttttcagtgttaattagtcatgttgaggagaaacaaattctcaaattccttctctgcattacaataactatgaaactcacaagcagtgtgtaccaactcaaatagttaacttcatatacaaccaataccaagggtttcagtaattatgttttaagcaaaagcaaacgattgcagatcacatgatttaagactacagtttattcaatatgtctccaagcattaaaaagataattctgtgaagttaaactcagtaaaattatatcttaaagtgcttttattttgctgtttttaaaatctgtttggggaacaactcataacttctttaagtaattgatgtcaaataatgcaccctgtacttctggagaacacagcattttcaaaattgctcttttcaatctaattatatcagaaaaatatcttcaagagcttagtatttcccaatttttgatcctgatcctggtaacctttcatcaagatccaagcttatgcatagggttctcatctagacccatctgaaattctatacaaatagggagacatattaaatacaaaggtctgtgtaaattgacttaattactattttacaatgaaaaggaattttattacatctttacatcattttaaattggatattcctgtttaatattactgcaagattaaaaatttgcccccacatatctaaaagcagcttgctttttcttaaaatataaaaaccaaaggaatttcttttgtagcatcgtagagaaagcaacagctttatgctcactcttgtatgttcgtgtaacaaaaaagtctgccactggctctatttccgaaaatctccacagaaatgtgaatccacatatagaccacgctcccgggacagctgatccacatgccggagttctcccactgccaaacagctcccaaaccttctagtggcttaaaaatgctttccttgagaaatacacgatccgcccaagtcacagcagctttcccagtccaatctccaggctcttccaaagggttcgagattctgattccaagaaggtgctgagcatccagtattgtgtcttgactcctctcaggctgggcatgttcctctagggatcaacatcatcaaggtcacttctcaactcaccaatcatcatgggagattctgaaccctgcagaaaagaaaaggaagttaaagttcatacggttagagaaaaggttttctatgctgacttgtgttctgcaatttaaacatgtcttcatctggcaacttaatgcaatgtttatcaaagggtaataaaatgtgataactattacatctaatatttgacaattcatgattatgtaaaacatgtacatttctatgatctcatttagtcagtgaaacaacccagcgacttgtctaaagtcacaatgctactctgcacccatgtgagaacgcagagcagtgataaagctgggagaggcattgatggccattgtgcccgcttcacgttgggcactgtgtgagcctccctgccctgcacctgccaaatatgggctctgggtcactcctgggtctgaaggctacctctgttaccatctgtgtggcctttggcttacacacttggcgaatcgttctgaatactcaccgtgtgccatggggctgatctagttggagctggggtggggaggagcaaggacagtctctctaaagtgacaacctaagctgagtgagagttgggggtgagtaggggggccctgaggtggaaggaagagagtacatttgataaataaaattcagaaaatgggccaggcacagtcgcttatgcctgtaatcccagctacttgggaggctgaggcaaggagaatcgctggaacctgggagaaggaggtagcagtgaggtgagattgcaccactgcactccagcctgggtgacagagcaacactccatctcaaaaaaaaaaaaaaaaaaaaaaaaaaatcagaaaatgggggtggggaggtgcgcaggtgctagatcaagcaggactgtgttgaggattctggcttttctcctcatacaaagcctttgaaaggttttagtgcatgaaccagagagaagcaggggtggaggtgaggggatccttacagacgtaggcagagaggggctgatgacaggtggaggagagggacgagcaccctttcaaagggagctgtccgggatgacatgggggtgctgtgtgtgagataaggaacactgacggagggccagctttggtgggcgcagggaggaggggctgggcacatcgagtctgaggtctttaaggtatgccaagtggagaacgtcaagaacaagagagctggatgttcatgttcagaaatccaaggtgggtgcggagagaatatggagtgagggcaggaggatacaggttagagactccacaaacctttactggtggtccagaagaggcagtactaggaaggagacagagaaggaacagccagaagggtttgaggaaaactacgagagagaagtgtcaggaaagccctggaatagtgtttcaaacgggaagagcgccaggagcgctagatgctgccgagcagtcggctaagatgaggcctgaaagctgcaggccacctgtcaccccaactgctgagttggagagaagagggagttagcagggaagaggctgaagagcgagtgagagataagaaaatggggaaagttaagtttagagaattagtcgaagtttggctgcaaagaagagaaaagaaggcaggggcaacagggagaagagaggctttgacagggcagaagagaggctttgacagggcagaagagaaaccagtgtgctgagacgtcgctgggaagggtctggcagggtggagcgttctggatattgaagagttacatacacattagaacgcaaagctctgccaaggtgggcggggatgagcgctaggggctttgggtggacagaggcaaacttcccactgtcacaggagaggagacaagaacagtgcagatgcttgggaattagtggccgcaggagctctcctgtgacagcttttattttctctgcaaatgaagtaggtgatgaggtaatgtgtggagtgaccttgggctaagtcacatcactgtgctgggctgcagttacctttctgtaaaatcagggtgacagctgcctcacatagtgcttatgaggatccgaaagataacacttaaaaaaaaatgacacctactacatcagtaacattcatttaatggggcctattctgtaccaagtactgtgaagggaccacagaggagactgctgttaaggaaagttacagactattggaaagacgtaatgattaactgacacttagttcagtgtttgcacacagtgggtgttcaatacatatttattttctttttctactataatgattggtattaaagctgtttttttttctttttttaaaaatacatgtcaaaattttcttggactcccctggcaagcaggtatacttcaagagcacgggagcttttctttcaagagtccacatttccaggaaggctggtgagagcaaacgagggactttcagtaacctggcaaggcagaataaagtgaacaagctggaacgaatccccctgtgccctggcttcatcgggactacctgcaggctgatcagggtggccagccacaaacacctcgaggccttccattcacttcacactgcagcactactcagccctgtaaacacacggttagtgcatatgctgagctgagatcactagagggcagcgctggtaactctttggactcacattccagaggaagcatcttgttttccctcagctgtggaaattctttttggaaagcttaagagcaaggctgccctttgcacacaaggacatgctgaccgttatacctgctgtagatgcctgtctccgttctcattggcaggactactctccgacccattactgcttcctgattgctctttttcattcaacaaagctgtggcatacgctaacgtgtcctgcagaagattcaaacacaagacgacaaagttagggcccattcagtggcagcagcaaccgccagggaagactacctttcatctgaccttcagtgggaccggaggcctgagagtgaggccttcatcacagtcaccagaaccccctcaacccctgtccctttttgtgaccagactgcccaacctgtatgactttccttctagacaaataatctgcacaaatttgtgtaagtgtacaccaatctgttttcttttcatagaaatccaattgtttcttctgcttgttctcatcttcaactcatacctctcttctcagaggttgcagtttctgagaaacacactgaaaatcctccataagtgatttagaccacgcaaaaacaagagacaactctcacctgagctgaaatggttcgctgaaaggtttttccagttgatgtttcattagagacattactctgtggtgtccagtaatgttctgacatctgagatgaaaggtcaaaaatgccatcagaggtgacaaataagcccccatgggttcacagtttctaccattagatattgagtcttaaaagcatcccaagtagggtacaagtctacccagaccttccatcacataaagcgattcaagacctcagtcaagtattgcttcttatatcatcatccctaccttttcccctatgaagttaagacatatgtattaggacaaatttaatgcacacaagatataaactgtagcaaagaaatgtttgaaatctgaaaacactttaaggtcagtctccatattcagttccagagatttttcctgacaagatgtgctattattgattcctatgttacagctagaaaaattcaatgttcagttaccttcttctgtagccactgcacagcccagctccagtggtgggaattctccttgaagtactccttagctgcaggacac

SEQ ID NO: 1907 - DNA, 3968 bp, Homo sapiens
gcagtgaacactctttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgaacctgggaagcagaggttgcagtgggccgggatcacaccactgcactccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggcctgagtatatacttggccttggagacaaaagaccagtgtgatcaagggcaagggcaagttacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 1908 - DNA, 3968 bp, Homo sapiens
gcagtgaacactctttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgaacctgggaagcagaggttgcagtgggccgggatcacaccactgcactccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggcctgagtatatacttggccttggagacaaaagaccagtgtgatcaagggcaagggcaagttacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 1909 - DNA, 3968 bp, Homo sapiens; identical to SEQ ID NO: 1907

SEQ ID NO: 1910 - DNA, 506 bp, Homo sapiens
gccagggcaggactggcttcccacttggagccagagacagggtagggggatagcctaggtccagaggacgtaccttgtcctcatcccagattcagctttgcctttgggatgagaaagggtcagggctcgcaacaggcctctcactgggacaaggagtcgggaggccatctctgcactcccagtgcctctgctttcctttggaaaggaagttgcaacaagaatggcttcagttgctcttggtcatttttatcctctcttccccctgtttgtatatgattcttgggtctattttaattaactttagtatgaaaatcacttgtcatgccaggcgcagtggctcatgcctgtaatcccaacattttgggaggccaaggtgggtggatcactaaggtcaggagttccagaccagcctggccaacatggtgaaaccccatctctactaaaaatacagaaatagccaggcgtggtgggaggtgcctgtaatcccagctactggggaggctgag

SEQ ID NO: 1911 - DNA, 506 bp, Homo sapiens; identical to SEQ ID NO: 1910

SEQ ID NO: 1912 - DNA, 456 bp, Homo sapiens
  misc_feature (76)..(76): n equals a,t,g, or c
ggtgcctgtaatcccagctactcagggagggctgaggcaagagaatctcttgaacccaggaggccggaggttgcanggagctgaaaatcgtgccactgcactccagcctgggtgacagagcgagactctgtctcagaaaaaaaagaacaactagagcagagtgagggtgatgatgggttgctctttaaactaggatggtcagtgtaggccacatctagaaggtacgatttgagcaatggcatgaaggaggtgaaaagttggtcttgtagatatctgaggatacgagttccaggtgcagggaacagcccatgcaaaagccctaagttgggaatgcgcctggtatgtttctggaggaacaagattagtgtgggcagaatggagtgaggaagaagaggtctactgtttgggggtccgaggggaggtttttgttttctttagagacagggttttgcactg

SEQ ID NO: 1913 - DNA, 479 bp, Homo sapiens
aaaattagctggatgtggtaccaggcaggtgcctgtaatcccagctactcaggaggctgaggcaagagaatctcttgaacccaggaggcggaggttgcagggagctgagatcgtgccactgcactccagcctgggtgacagagcgagactctgtctcagaaaaaaaagaacaactagagcagagtgagggtgatgatgggttgctctttaaactaggatggtcagtgtaggccacatctagaaggtacgatttgagcaatggcatgaaggaggtgaaaagttggtcttgtagatatctgaggatacgagttccaggtgcagggaacagcccatgcaaaagccctaagttgggaatgcgcctggtatgtttctggaggaacaagattagtgtgggcagaatggagtgaggaagaagaggtctactgtttgggggtccgaggggaggtttttgttttctttagagacagggttttgcactg

SEQ ID NO: 1914 - DNA, 506 bp, Homo sapiens; identical to SEQ ID NO: 1910

SEQ ID NO: 1915 - DNA, 1006 bp, Homo sapiens
caaaaggggcttctattgtattggtcatattttattttggtttaaaaaattttagagtaaatgtggcaaaatgttaatgcttgttaaatctgagtggagagtacattggtgttaagtgtgctgctatgcagggtgagtgaattactcaataactaaataattgtgacataatatatttatttatgcttccctgttatgatctacacataaaattactggagcattattgcttaacttcttgtaaaaaagttctgcaattgtagtgttattaagaaagtaatattgatttgtatagtgacagaggattttttcagtgtcactttgccagcagagatcttcatggtgggcattgcccctgcccatgtctcacttggccctgggcttgccccactaggtaccctgcccacctggccaggcaggctgtgcttggcttgagctctggcccagatcctgcacttgctctgcggctgagccaggcatgccatgacctacttccaccttgggagccggcgtctggatgaggggaatgctgtgacacttgaacagaggtgggcatgtgaccccaaagccccaaagggggtgttacagcatgctaacagttctttcagtctcacatccacagcccaacaaatggaggtgtgtggtgcccagaggtcccttctcccattgtttggcaagcaggaggggtgtgctacagggttacagctttgtttgcacttgccgtttggtgggtcctgagttcttttcccatgtccaagaataaggttgtgctgacagctagcggttgagtgaggcaaagagttttactcagtaacaaaacagctctcagcagagaaggaagcctgagttggacagcacccttacctgaagttgggtagtcttcccaccacctaaaagtgggtagcccaaagtgtggctgagcctggggcttttatatgctcagaatgggagtgtatgtgctaattggtttgtgagtatgcaaaaaaagctaaaaaaaaaaaaaaaa

SEQ ID NO: 1916 - DNA, 336 bp, Homo sapiens
gaatgtaagctaattaaatggcttattaaaggagattttcagatatttttgaaaatctatcttgatagtacttataagagataaatataaaaacttaaagatattggccaaaggagattaaaaaaaagtcaggcaattaaccagaacaacattagtgatattaatagaagctagtaaaatacaagagagaacacaaaacagacccatccctgtatagaatttggtgatatatgacagagatgaccatacaatcaattagaaaagaaagcattgttgatggtcctgattgagtaactatgtggatgtggagggcagtgtaaatgaaagcctaacttc

SEQ ID NO: 1917 - DNA, 15090 bp, Homo sapiens
acgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatggtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcacggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatggcggtcagcaggcagggctctgttgggtggtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcacctctccccgaccttcagccacctgcctctaattgcctcctagacactgcaaaattaatctacctcagactgagcccctcagtagctctgtcctaccaggtgttcaggccgcaagtcttgggagcctcttattgattttttattttttaaaatagcagagatggggtcttaccatgttgcccaggctggtctcgaactcctggcctcaagtgatcctcctgccttggcctcccaaagtgctaggactacaggtgtgagccaccatgcctggctttgggagtctttttctttttctgtttttttttgagatggagtcttgctctgtcgccaggctggagtgcagtggcgccatctgggctcactgcaacctccgactccctagttcaagcgattctcctgcctcagcctcccgagtaggtgggattacaggcacgcgctaccatgcccagctaatttttgtatttttagtacagatggggtttcaccatgttggccaggatgatctctatctcctgacctcgtgatccacccccctcggcctcccaaagtgctgggattacaggtgtgaaccaccatgcctggccgggagtctttttcttgtaccacatgttcctctatcagttattcctcttggctctgcttctagaccatgtccagagactgctgattttctgccactaccatgtttggagcatgccttgctcacagcttgcctgttccctgccaccagctgggctccatcctgtccatttggcagccccaatgatccccacttcccctggtcccaacacaatgtaaacagttcctcaagcaagccatgcttcctctttccaccttgaaaatgtcccttgatgtgcctgccctccaaggcaacttctgttctactgggcccataagaaataggtggaacattcttgctaccttagttcctaaagcaagagcttgtccgccaagtcttcagggcccccccggttccctccatcctcttatgggccttagttcccctggccaagcccagcgctgatgtctcctttgccgagattcccccggctctgaccccactacaccaggatggtctgtttctggcctgactccccaccaggctgggacatgtcaaggacagggctcagggcttgaaaccatgcacagggatgctaagatgtagctccagtttcttgaatgactgcagccctatctcacccaaggttagacatggccgtcggctcccccttgcccaggggtcagtgccagttgctcggcctggcatctgcagcccagcctgaccccggatcttgccgcacctgccgccaccctgaagcctttgtttcctgactgatgcatgcgcaggctacacctcttaacatatgctgttccctttgcctggaatgcccttcctgcctcatcttctctctagcccaagctgggcacggtgtctcaggcctgtaatcccagcactttgggaggccgaggcgggtgaatcacttgaggtcaggagtttgagaccagcctggccaacatggtgaaaccctgtctctactaaaaatacaaaaattagccaggtatggtggtaggggcctgtaatcccagctactcaggaggctgagacatgagaatcacctgaaccctggggggaagaggttgcagtgagctgagatggcgccactgcatttgcctgggcaatagtctcaaaaaaagaaaaaagggccgggtgtggtggcttacgcctgtaatcctagcacttgggaaggctgaggtgggtggatcatgaggtcaggagtttaagaccagcctgaccaacatagtgaaaccctgtctctactaaaaatacaaaaattagctgggtgtggtggcacgcacctataatcccaactactcaggagactgaggcaggagaatcgcttgaacttgggaggcggagtttacagtgagccaagattgcgccactgcactctagcctgggcgacagagcaagacttgtctcaaaaaaaaaaaaaaaaaaaaaaaaaagatcctagccttcaggccctggagtgactgaggtaaggacagggctgagatggggcaggcatctaggtatgaagtagggctgggggcacctcacctccaccaggtcccagaagaacaccttcccgtcctcagaacagctgaccacatgtgtgtcacgctcgctcaggcagcagtccagcttgtattcctggttcttatggcccttgtacctaagggtggacaggatcggggggcttggtcctctccaggggtgggagaggagggaaggggatccccacgaccacaaggactcactcgcccagcagctcccctgtgtctttgtccaggagccgcaatgtggagtccaggctggacaccagggtgcactgcccatcccggctgaagcaggtgcaggtgatggggccttgggggaagggtgggtaggtgagtgagggtggggtgcccctggttggccccccatcttccctgcctgtcccacatccccagccacactcactgcccacgtagtctgagaagagctgccccatccttaggtcatagcgtctcacgcggccatccacggagctgcaggagagggtagatccagcgggaaccttgactacactcacatggctccaggcagccctgtgccttcccagcccagtgggcctgctcttccagtgcacaggagtggaattctgaagctctggccttgagactcaggcccagggccaattacgtcctactccatcatttccaagacccacaccccctttccaagcccttggagtccttctgattcccccttttcttccttttgtttgagacagagttttgctcttgttgctcaggctggagtgcaatggcatgatcttggctcaccggaacctctgcctcccgggttcaagagattctccttcctcagcctcccgagtagatgggaatacaggcatgcaccaccacgccctgctaattttgtatttttagtagagacggggtttctccatgttggtcaggctggtctcgaactcccaacctcaggtgatccgcccacctcagcctcccaaagtgctgggattacaggtgtgagccaccccacctggcccaattcccccttttcctgcattctccagctcctcctcctcagtactcagtcccaccactttccccactacccagcaccagcatctagactgttctggtctccctgcaccccccacagccaccagagggagcacttttcaaagtacagttgacccatgaacaacacggtttgaactgaacgcgtccacttatatgtggattttcttctgcctctatcagctgtgagacaccaagatcaatccctcctcttcctcctcctctgctttctcaacacgaagatctttatgacgatctcttcacttccacttaatgaatagaaaatatattttttccaccaggcgcggtggctcacgcctgtgattccagctctttgggaggccagggcaggtggatcacgaggtcaagagatggagaccctcctggccaacatggcgaaaccccgtctctactaaaaatacaaaaattagctgggcgtggtggcacgcgactgtagtcccagctactagggaggctgaggcaggagaatcgcctgaacctagaagttagaggttgcagtgagccgagatcacgtcactgcactccagcctggcaacagagcgagactgcgtctcaaaaaaaacaaaaattcttccttatgattatttttatgtatttatttatttaatttatttacttattttgagacggagtcttgctctatcgcccaggagtgtagtggtgcgatgtcggctcacagcaagctctgcctcctgggttcactccattctcctgcctcagcctcctgagtagctgggactacaggcgcctgccactatgcccggctaattttttgtatttttagtagagacggggtttcaccgtgttagccagaatgatctcgatctcctgacctcatgatccgcctgcctctgcctcccaaagtgctgggattacaggcatgagccacagcgcccggcctatttttatttatttttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaaggtgggcggggttgagcttctatgggtgtagttggacctgagaacgaggcccgggggcgggtttggaatgaagcggggtgtcttgtcattgctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgcc

SEQ ID NO: 1918 - DNA, 15090 bp, Homo sapiens
acgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatggtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcatggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatggcggtcagcaggcagggctctgttgggtggtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcacctctccccgaccttcagccacctgcctctaattgcctcctagacactgcaaaattaatctacctcagactgagcccctcagtagctctgtcctaccaggtgttcaggccgcaagtcttgggagcctcttattgattttttattttttaaaatagcagagatggggtcttaccatgttgcccaggctggtctcgaactcctggcctcaagtgatcctcctgccttggcctcccaaagtgctaggactacaggtgtgagccaccatgcctggctttgggagtctttttctttttctgtttttttttgagatggagtcttgctctgtcgccaggctggagtgcagtggcgccatctgggctcactgcaacctccgactccctagttcaagcgattctcctgcctcagcctcccgagtaggtgggattacaggcacgcgctaccatgcccagctaatttttgtatttttagtacagatggggtttcaccatgttggccaggatgatctctatctcctgacctcgtgatccacccccctcggcctcccaaagtgctgggattacaggtgtgaaccaccatgcctggccgggagtctttttcttgtaccacatgttcctctatcagttattcctcttggctctgcttctagaccatgtccagagactgctgattttctgccactaccatgtttggagcatgccttgctcacagcttgcctgttccctgccaccagctgggctccatcctgtccatttggcagccccaatgatccccacttcccctggtcccaacacaatgtaaacagttcctcaagcaagccatgcttcctctttccaccttgaaaatgtcccttgatgtgcctgccctccaaggcaacttctgttctactgggcccataagaaataggtggaacattcttgctaccttagttcctaaagcaagagcttgtccgccaagtcttcagggcccccccggttccctccatcctcttatgggccttagttcccctggccaagcccagcgctgatgtctcctttgccgagattcccccggctctgaccccactacaccaggatggtctgtttctggcctgactccccaccaggctgggacatgtcaaggacagggctcagggcttgaaaccatgcacagggatgctaagatgtagctccagtttcttgaatgactgcagccctatctcacccaaggttagacatggccgtcggctcccccttgcccaggggtcagtgccagttgctcggcctggcatctgcagcccagcctgaccccggatcttgccgcacctgccgccaccctgaagcctttgtttcctgactgatgcatgcgcaggctacacctcttaacatatgctgttccctttgcctggaatgcccttcctgcctcatcttctctctagcccaagctgggcacggtgtctcaggcctgtaatcccagcactttgggaggccgaggcgggtgaatcacttgaggtcaggagtttgagaccagcctggccaacatggtgaaaccctgtctctactaaaaatacaaaaattagccaggtatggtggtaggggcctgtaatcccagctactcaggaggctgagacatgagaatcacctgaaccctggggggaagaggttgcagtgagctgagatggcgccactgcatttgcctgggcaatagtctcaaaaaaagaaaaaagggccgggtgtggtggcttacgcctgtaatcctagcacttgggaaggctgaggtgggtggatcatgaggtcaggagtttaagaccagcctgaccaacatagtgaaaccctgtctctactaaaaatacaaaaattagctgggtgtggtggcacgcacctataatcccaactactcaggagactgaggcaggagaatcgcttgaacttgggaggcggagtttacagtgagccaagattgcgccactgcactctagcctgggcgacagagcaagacttgtctcaaaaaaaaaaaaaaaaaaaaaaaaaagatcctagccttcaggccctggagtgactgaggtaaggacagggctgagatggggcaggcatctaggtatgaagtagggctgggggcacctcacctccaccaggtcccagaagaacaccttcccgtcctcagaacagctgaccacatgtgtgtcacgctcgctcaggcagcagtccagcttgtattcctggttcttatggcccttgtacctaagggtggacaggatcggggggcttggtcctctccaggggtgggagaggagggaaggggatccccacgaccacaaggactcactcgcccagcagctcccctgtgtctttgtccaggagccgcaatgtggagtccaggctggacaccagggtgcactgcccatcccggctgaagcaggtgcaggtgatggggccttgggggaagggtgggtaggtgagtgagggtggggtgcccctggttggccccccatcttccctgcctgtcccacatccccagccacactcactgcccacgtagtctgagaagagctgccccatccttaggtcatagcgtctcacgcggccatccacggagctgcaggagagggtagatccagcgggaaccttgactacactcacatggctccaggcagccctgtgccttcccagcccagtgggcctgctcttccagtgcacaggagtggaattctgaagctctggccttgagactcaggcccagggccaattacgtcctactccatcatttccaagacccacaccccctttccaagcccttggagtccttctgattcccccttttcttccttttgtttgagacagagttttgctcttgttgctcaggctggagtgcaatggcatgatcttggctcaccggaacctctgcctcccgggttcaagagattctccttcctcagcctcccgagtagatgggaatacaggcatgcaccaccacgccctgctaattttgtatttttagtagagacggggtttctccatgttggtcaggctggtctcgaactcccaacctcaggtgatccgcccacctcagcctcccaaagtgctgggattacaggtgtgagccaccccacctggcccaattcccccttttcctgcattctccagctcctcctcctcagtactcagtcccaccactttccccactacccagcaccagcatctagactgttctggtctccctgcaccccccacagccaccagagggagcacttttcaaagtacagttgacccatgaacaacacggtttgaactgaacgcgtccacttatatgtggattttcttctgcctctatcagctgtgagacaccaagatcaatccctcctcttcctcctcctctgctttctcaacacgaagatctttatgacgatctcttcacttccacttaatgaatagaaaatatattttttccaccaggcgcggtggctcacgcctgtgattccagctctttgggaggccagggcaggtggatcacgaggtcaagagatggagaccctcctggccaacatggcgaaaccccgtctctactaaaaatacaaaaattagctgggcgtggtggcacgcgactgtagtcccagctactagggaggctgaggcaggagaatcgcctgaacctagaagttagaggttgcagtgagccgagatcacgtcactgcactccagcctggcaacagagcgagactgcgtctcaaaaaaaacaaaaattcttccttatgattatttttatgtatttatttatttaatttatttacttattttgagacggagtcttgctctatcgcccaggagtgtagtggtgcgatgtcggctcacagcaagctctgcctcctgggttcactccattctcctgcctcagcctcctgagtagctgggactacaggcgcctgccactatgcccggctaattttttgtatttttagtagagacggggtttcaccgtgttagccagaatgatctcgatctcctgacctcatgatccgcctgcctctgcctcccaaagtgctgggattacaggcatgagccacagcgcccggcctatttttatttatttttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaaggtgggcggggttgagcttctatgggtgtagttggacctgagaacgaggcccgggggcgggtttggaatgaagcggggtgtcttgtcattgctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgcc

SEQ ID NO: 1919 - DNA, 3830 bp, Homo sapiens
ctgggcacggtggctcatgcctgtaatcccagcactttgggaggctgaggtgggcggatcacgaggtcaggagatcaagaccatcctggctaacatggtgaaaccccgtctctactaaaaatacaaaaaattagctgggcgtgtggcgggcgcctgtagtcccagctacttgggaggctgaggcaggagactggcgtgaacccgggaggtggagcttgtagtgagccgaaatcacaccactacactccagcctgggcgacagagcaagactccgtctcaaaaaaaaaaaaaaaaaaaaaaaagctctctgattttagctgttaggtgggagatgggttggaggataccaaagccagcttgcaggctatggggataaagaaaacacctggatttcggacctactttataggtagaggttggcagacatgctgagaaggatggatgtggggtgtgagaaaaggggagacagcaagctgcgctcctcatttttaatttttatttatctatttttgagacggagtttcgctctgttgcccaggctggagtgcagtggcaccatctcagctcactgcaacctccacctcccgggttcaagtgattctcctgcctcagcctcctgagtagctgggattatgggtgtgcgccaccacacccggctaatttttgtattttttagtagagacggggtttcgccatgttgtccaggctggtctctaactcctaacctcaggtgatctgccctccttggcatcccaaagtgctgggattacaggtgtgagccaccgcgcccagccccaatccctatttttcagtctagtggatgagtggagggtggggccgtttgctgagatgcagaaagatcagggataggtggagagggagctgagggggcaactttgaggtccaagcgaggatgtcaaggaggatgtctgtctcctccaacaaggtaggctcattccagcctcacggcttttgctgttctgtcttcccatgtgcaggaaatggcctctctgcatcttcacatacggggattttctcagccttctggctttggctcaaatctcacctccttggcgtccttcacccatccctccaactaaaatcccgaactcctccacctaaagactcaaattatcctgtttaaatcctgattgcgctgggcgcggtggctcacacctgtaatcccagcactttgggaggccgaggcaggcagatcacctgaggtcaggagttcgagactagcctgaccaacatagtgaaaccccatctctactaaaaatacaagaattagccgggcgtgatggctcatgcctgtaatcccagctactcgggaggctgaggcaggagaattgcttgaaactgggaggcagaggttgcgatgagtggagatcgcgccattgcactccagcctgggcaacaagagcgaaactctgtctccaaaaaaaacaaaaaacaaaaaaggcctgatagcactcaccactattgttaactttctatcttcccaatcagattgtgggctccagtagggcagggtccacatcttggtcttgttcaccactaaatccttagtgcctagcacggagcccaccatagagaatagactacatgaattgtagagtgagtgaataatcctgttggccgtatgcactgttaggagggtgtgtttgagatacagatgacacccagggtctcacattcttgcaggagggaaagagacgtcagccctgggtcccagaagaggccactgacccagtgggagttcagggaaggcttcccagaggaggtggaggtgacagctgcagctataagggaaggaagaacagagcgttatgcagcatgtgaaggctttggagacttgtgagggcacgaaccgggctcactatcccattagacaaaagtggctgaggaaggatgaaactgtgtctaactctgcctggtgaccgaaatcttgtccatgggtgacgcttaagaagtgaccctcggccgggcgcagtggctcacgcctgtaatcctggcactttgggaggccaaggcgggcgggtcacgagttcaggagatcgagaccatcctggctaacacggtgaaaccccatctctactaaaaacagaaaaaattagccgggtgtggtggcgggcacctgtagtcccagttactcgggaggctgaggcaggagaatggcatgaacctgggaggcagagcttgcagtgagccgagattgcgccactgcactccagcctgggcgacagagcgagactctgtctcaaaaaaaaaaaaaaaaaaaaaagtgaccctcataaaaaaattagctgggcacgatggtgcacactagtcggaatgctggggtgggaggatgacctgagtccgggagtcagaggttgcagtgggccgagatcgcgtcacagcactccagcctggcgacagagtgagaccctatcaaaaaatagcagcaggccaggcgcggtggctcatgcctgtaatcccagcactttgggaggctgaggcgggcggatcacgaggtcaggagatcgagactaccctggctaacacggtgaaaccccgtctctactaaaaatacaaaatattagccgggcgtggtggccggcgcctgtagtcccagttactggggaggctgaggcagaagaatggcgtgaacctgggaggcggaggttgcagtgagccgagatcgtgccactgcactccagcctgggagacagcgcaagactctagctcaaacaaacaaacaaacaaaacagcaacaacaacaacaaaaccatcctcccctcccgaggggacagaacagaaacgaatgggcgagtgccgggccaagcagtgggtctccagcaggtggcattaaaataggaattttggctggggacggtggctcacacctgtaatctcagcactttggaaagcccaggcgggcggtcacctgagggcagaaccagcctcgccaacatggtgaaatgccatctctactaaaaataaaaaattagccaggcctggtggtgggtgtctgtaatcccagcaactcgggaggctgaggcaggagaatcgcttgaaccaggggggcagaggttgcaatgagtcaagattgcaccaccgcactccagcctgcgtaacaagagcgtgtaactcttgtctcaaaaataaattaaataaataaataataaaaataaaaaagaatcttcattcatgggaagtcgagaacacatgaaaacaagtaaaggccgaagcgcagtggctcacgcctgtaatcccagcactttgggaggctgaggcgggcggataacctgaggtcggaagttcgagaccagcctgaccaacagggagaaaccccgcctctactaaaaatacaaaattagccgggcatggcggtgcatgccagtagtcccagctactcgggaggctgaggcaggagaatcgcttgaacccggaatgtggaggttgtggtgagctgagatcgggcaattgcactccagcctgggcaacaagagcgaaaccctgtatcaaaaaaaaaaaaaagaaaaaaaaaggaagaaaaggcctaaaggcgccgggcgcggtgggtcacgcctgtaatcccagcactttgggaggccgaggcgggcgaatcacgaggtcaggagatcgagaccaggtgaaaccccgtctctactaaaaatacaaaaaaattagccgggcgtggtggtgggcgcctgtagtcccagctactcgggaggctgaggcaggagaacagcgtgaacccggaaagcggagctggcagtgagctgagatcgcgccactgcactccagcctgggtgacagagcgagactccgtctcaaaaaaaaaa

SEQ ID NO: 1920 - DNA, 20245 bp, Homo sapiens
gcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgcgtgagccgggacgggaggggtggatctagggcagatgggctttagagggggtagttggaaaatgtttttggaggactatacaggagtgaaattacgtgggctgcgaagctgggtcagcagagagaacaacgcatctcgagggggcttggccttaagtgccgtgaccacactaggaccagccaggggtgtttctgtgcaaagtgggtgggtttggagaaggcctgctgtgacccatgccctctctgacccccgcctccccagttccaggtcatcgtttataatcccctggggcggaaggtgaattggatggtacggctgccggtcagcgaaggcgttttcgttgtgaaggaccccaatggcaggacagtgcccagcgatgtgagcccaaacaacgaatattcccccgctgggactcctcccccagtgggcatttcctcatcgcccccatggatatcgcctgcttccatgaatacctcccactcatgcatatctcttcccccctcttgtatcttctccctctgccccttaatatcagtctccccttgggaacatatgcctcctgtgagtggtcctcccttttttttttttttttgagacggagtctcgctctgtcacccaggctggagtgcagtggcgcgatcttggctcacttcaaactccgcctgctggattataggcatgagccaccgtgcctggctggtcctccattttaataccccgcttccccaggaaaatttattgctgtttatggacatctccttcattccagaaaacgtcctcccccaaacctcttcctcccccgagaacctgcctcaagggtttcttcccctacttcctccttcactcccccgactccatggtctctccaccctcccggtgggtttttttttccacctggtgaatcttctctgcaatcatttccttggaatctgactgtccccccaccacacacacctccatttcctttccccatctcaggactcttttccttccttgagttttttgtctccatgcatgtatagctttccatgggtactcttgactcagtttccctcctcctttatccgaggtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgaggtgagaccccatttcaatcccctttcctgctcctgtgacaaatttgaagtgtcatggtgagctgtgtggactctgggtcagcaggtccctaggcttatgacctcctgtcacaactcccctcattgtgtgtccttgagcaagtgacctttgtctgagcctcagtgtcctttcctgggactgttatgaggacccagtgtgatcatgggtgacacttgacagacatgtcagagttggtggcaggtggtggttcgcaattttggcagggacgtttcagggaaggtgttcccgataaaggtgacatttaagatatgacctgagggagggagccgtgtggctatttgaaggaagagagatccaggtggggagagaataacaggcataaaagccttcgagcaggagagtgtgcagaattccaggagccacaaggagctcagtgtggctgaagcagggtgaacgggtgacaggtcagaccttgagggccttgaggaccaacaggaagactttggcttttgccagtcattgttgctcatgtgtctactcctagctctttgggaggctgaagcgggaggatcacttgagcccaggagttgtcccagctaattgggaggcccagatgggaggtttgtttgagctggggagttcgaggttgcagtgagtaatgattgtcccactgtactccatcctggcaacagagtgaaaccctgtctgaaaagaataataataaaataggccaggcatcgtggattatacctgtaattctagcaccacgggaggctgaggtgggtggatctactgagctcaggagtttgagaccagcttgggcaacatggtgaaacccagtctctacaaaaaattagctgggggtggtggtacacgtctgtaatcccagctacttgggggctgaggaaggaggattgcttgagcccaggtggcagaggttgcagtgagccgagatcatgccactgcactccagcctgggtgacaaagtgagaccctgtctcaataaaataaaataaaagaagttctgcagtaggactgttcatgttaggaagaaaacatctttttcatatttttattaaaataaaataaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccagcctgggcaacagagtgagactccgtctcaaaaaaaaaaaaaagaaaaaaaaagaaaaaaagaaaaggctggggtgggcacgttggctcatgcctgtaatcccaggactttgggaggctgaggctggcaggtcacctgaggtcaggagtttgagaccagcctggccaacacagtgaaacctcgtctgtaccaaaaatacaaaaattaactgggcgtggtggtacacacttgtagtcctagctactcgggagggagaggcaggagaatcacttgaacccaggaggtggaggttgcagtgagccgagatcatgccactgcactccagcctgggggacagagcaagactctgtctcaaaagcaaacaaaaaaaaaatcaggttgaatggctgggtgtggtggactgcttgagcccaggagttggacactagccccaggcaacatagtgggacccccatctctagaaaacaaatttaaatttttttttttttaatttagtagagatggagtttcactatgttggccaggctggtatcaaactcctcacctcaggttatccacccaacttggtctcccaaagttctgggattacaggtgtgagccaccacgctcggccctaaaaaaattttaaattgagaaaaaaaggggccaggcgtgttggctcatgcctgtaatcccagcactttgggaggctgaggggggggtggatcatgaggtcaggagttcgagaccagcatggccaatattgtgaaaccctgtctctaataaaaatacaaaaattagccaggtgtggtggcatgtgcctgtagtcccagctattcaggaggctgagtcaggagaattgcttgaacccgggaggcggaggttgcagtgagccaagatcacgccactttctgcactccagcctgggcgatagagcgagactcagtctcaaaaaaaaaaaaaaaacaaaaaacccaggccaggtgcagtggctcacgcctgtaatcccagccctttgggaggccaaggcgggtggattacctgaggtcaggagttggagaccagcctgaccaacatggcgaaaccccgtctctactaaaaatacaaaaattagccaggcatggtggcatgtgcctgtaatcccagctacccaggaggctgaggcaggagaattgctggaacccaggggcagaggctgtagtgagcagagattgcgcccctgcactccagcctgggcgacacagcaagtttctgtctcaaaaaaaaaaaataaaaatccggctgggcacagtggcttatgtctgtaatcctagtactttgggaggccaaggtgagcagatcacttgagttcaggggtttgagaccagcctggccaacatggtgaaaccctgtctctactaaaaatatgaaaattagccaggcggggtggtgggcacctgtaatcccagctacttggatagctgaggcacgagaatcacttgaacccgggaggtggggggtgcagtgagccaagattgcaccactgtactctagcctgggctacagagtgagactcagtctcaaaaaaaaaaaaagaaaaaagaaaaattaaaaaaagaaaacacacacacatacacacacaaacccatctgtggacccttttctgcccagcacatccgggcaacgtttgatcctgacacagggctgttgatggagattatgaacatgaatcagcaactcctgctgcctgttcgccagaccttcttctggtaagggaagatcaccaggcctgagggtggggtggtggtgctcggcatggagctagggccccttacctgactctcacctgccccaactccaggtacaacgccagtataggtgacaacgaaagtgaccaggcctcaggtgcctacatcttcagacccaaccaacagaaaccgctgcctgtgagccgctgggctcagatccacctggtgaaggtcagggactaggaatgatgagtgggcagttgggaatggggaagttatggagcccaagagggtggtgggccatgtgtagagtgagggtaggggaggatttacttttccttcagatcagtgggctaagacccacagatcagcgggggaaatatttgagggtccttccatagaattgatattcatagctggtcgtatgagagtctccccataggacacatcatacaaagccattcacatctgctgtggacgtttacatacttagttttggaaattgggggtggggcattcccacttggcccatgaatcaggagagccaaatatcactgcttgaagaattcaccaaagtctgtagtaagaggagcttctatctggagtgaatatttgagagtccacccttggattgattgggtttgggtgagtctcagggtgaatgcctatgggtgcatctggctaggaacagtggtttcccagggcctctcattgatgtttgactttcatagatgacaaaactcacatttgtccacattcaagagcctcgcgtttcatgtgagtccctttgagatgaatgtctgcatatctgtatatagttttgcctgttctaacagagttacccaaattaactgtgactagaataagatagaagattattttcttctaacaaaaagtctggctgttagtccagagaaagtggggtggttccataatcacccaggacctcctcttctatcttgttgctctgccttccccaatattcagtttccacctcatggtccaagatagctgctgaagctccagccgccacatttgtgtttgagtcagtagcagagggacaggggcaaggaacattgttgacaccacttggatcactttctatggggcaaactggtcactcagctactgatagcctcagggaagactggacaatatagtctttatcccaggtagccatgtgccaagctagaatcctattctatggggcaatggtgaacaggaggcgtttatgccacgctcaagagtgatgtggtaagccagatgcagtggctcatgcctgtaatcacagcactttgggagactgaagcaggaggatcgctgagcataggagttcaagaccaggtgggagcatttgctgattaggtgcctacatagtgatgccctgtctcaaaaaaaaaaaaaaaaaaagaggccgggtgcagtggctcacgcctgtaatcccagcactttgcgaggcagaggcaggcagatcatctgaggtcaggagttcaagacaagtctggccaacatggatagaaaccccgtctctactaaaaatacaaaaattagccaggggtggtggcaggtacctgcaatccctctactcgggaggctgaggcaggagaattgcttgaacccaggaggcggaggttgcagtgaggcaagattgtgccactgcactccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctcacgcctgtaatcccagcactttgggaagccgaggcgggcagatcacaaggtcaggagatcgagactatcctggctaacatggtgaaaccccgtctctactaaaaatacaaaaaaatcagccgggtgtggtggcgggcacctgtagtcccagctactcgggaggctgaggcaggagaatggcgtgaagccgggaggcggagcttgcagtgagccgagatcgcgccactgcactccagcctgggtgacagagcgagactccatctcaaaaaaaaaaaaaaaaaaaaaagagttggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaagggaatcaccccttatctgcagcatctcaaagctgcctggggttggggttgactgccctctactttcacccttcaactcccaggatggaaacatgcagctgactgtgctgactgaccgctcccaggggggcagcagcctgagagatggctcgctggagctcatggtgagtgggtcagagccccatccgagccagggtcctcccaacctggacccctgctggaccttgaaggctgtttctggcccagttctctgctttcaggccccactaagctgaggactccgtttctttcttttcttctctttgagacggagttttgctcttgttgtccaagctggagtgcaatagtactatctcagctcactgcaacctctgcctcctgggttcaagtgattgtcctgcctcagccttccgagtagctgggcttacaggcacacaccatcacgcccggctaattttggtatttttagtagagatggggtttcaccatgttggccaggctggtctcgaactccttacctcaggtgatccactcacctcggcctcccaaagtgctgggattacaggcgtgaaccaccgctcccggccaaggactccatttctgtgtgtggcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcaggtgaggggcagcggggtaggcagagaggaccggattgaagtctaccagggagccgggtttgggtgcggagtttcctaggctcagcggggatccatttggccataattagccccaaaccctcgggccaaccccatcccctgggcagtccccgcccagtgccagcccagtcccaacccccctggactgtgtagaggcacagccctagctcatgcccctaaaccaccaactcacctccggccccgcccatttcactttagccccgccctctcaccgcccccaggctctgtcctgcctcacccagccccgcggcttcagccccgccgtaactcccaaagtctcaggtcacatcagttctgctccatcgggactcgaaccctaagcttgggaccgacccatctccccattggctcagtcctccctgtcacggccctggccgctcctctcggctgagccttgcccctctccggcgaaaccccgcccctacaacctagccctgcctcctgacctggctcggccccgcccttctccatccaggccccgcccctctccaactcagccccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggagatcggagagaggcaagagagagggagagaagagaaacctggctttgccccaactcatctgggcccatccccttccccgcaggacctgttctccaccttcaccatcacccgcctgcaggagaccacgctggtggccaaccagctccgcgaggcagcctccaggctcaagtggacaacaaacacaggtggggccctggtcaggggtagggaaggggtggagtcttacctggggccggcaggtgggggcaatgtgtgaggcatgggatgttggccaggacccaaaaaggtcatgagggtatggggcagagtccagacccaggttaggggcttaaaggatctgaaatgggtgcggcaaaccaggaatgggtcttgaggtttgtgggtgctgtttagtcccaagaacaagatttgaaaatccccatccatgtctagttctgggagggtgttcatcacccctggggtcagattgagggtacgaggacagtggccagattgagggtatgaggacattggacctgggggtggtattcggggccggggaagcaggttaagagtctgggattgaggccctggagacagattcggggatatgcagctgtgtctagacccaggggaggaagcatcgtggggtgagtcagaggaagtctgcacctcctcactcctccttccccctgcacctctccaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtg

SEQ ID NO: 1921 - DNA, 9796 bp, Homo sapiens
gcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgc

SEQ ID NO: 1922 - DNA, 3844 bp, Homo sapiens
tcatgcctgtaatcccagcattttgggaggccgaggcgggcagatcacaaggtcaggagatcaagaccatcctggctaacacggtgaaaccctgtctctatcttagtaatactttattaattagtctgggcgtgtggcgggcgcctgtagtcccagctacttgggaggctgaggcaggagactggcgtgaacccgggaggtggagcttgtagtgagccgaaatcacaccactacactccagcctgggcgacagagcaagactccgtctcaaaaaaaaaaaaaaaaaaaaaaaagctctctgattttagctgttaggtgggagatgggttggaggataccaaagccagcttgcaggctatggggataaagaaaacacctggatttcggacctactttataggtagaggttggcagacatgctgagaaggatggatgtggggtgtgagaaaaggggagacagcaagctgcgctcctcatttttaatttttatttatctatttttgagacggagtttcgctctgttgcccaggctggagtgcagtggcaccatctcagctcactgcaacctccacctcccgggttcaagtgattctcctgcctcagcctcctgagtagctgggattatgggtgtgcgccaccacacccggctaatttttgtattttttagtagagacggggtttcgccatgttgtccaggctggtctctaactcctaacctcaggtgatctgccctccttggcatcccaaagtgctgggattacaggtgtgagccaccgcgcccagccccaatccctatttttcagtctagtggatgagtggagggtggggccgtttgctgagatgcagaaagatcagggataggtggagagggagctgagggggcaactttgaggtccaagcgaggatgtcaaggaggatgtctgtctcctccaacaaggtaggctcattccagcctcacggcttttgctgttctgtcttcccatgtgcagaaatggcctctctgcatcttcacatacggggattttctcagccttctggctttggctcaaatctcacctccttggcgtccttcacccatccctccaactaaaatcccgaactcctccacctaaagactcaaattatcctgtttaaatcctgattgcgctgggcgcggtggctcacacctgtaatcccagcactttgggaggccgaggcaggcagatcacctgaggtcaggagttcgagactagcctgaccaacatagtgaaaccccatctctactaaaaatacaagaattagccgggcgtgatggctcatgcctgtaatcccagctactcgggaggctgaggcaggagaattgcttgaaactgggaggcagaggttgcgatgagtggagatcgcgccattgcactccagcctgggcaacaagagcgaaactctgtctccaaaaaaaacaaaaaacaaaaaaggcctgatagcactcaccactattgttaactttctatcttcccaatcagattgtgggctccagtagggcagggtccacatcttggtcttgttcaccactaaatccttagtgcctagcacggagcccaccatagagaatagactacatgaattgtagagtgagtgaataatcctgttggccgtatgcactgttaggagggtgtgtttgagatacagatgacacccagggtctcacattcttgcaggagggaaagagacgtcagccctgggtcccagaagaggccactgacccagtgggagttcagggaaggcttcccagaggaggtggaggtgacagctgcagctataagggaaggaagaacagagcgttatgcagcatgtgaaggctttggagacttgtgagggcacgaaccgggctcactatcccattagacaaaagtggctgaggaaggatgaaactgtgtctaactctgcctggtgaccgaaatcttgtccatgggtgacgcttaagaagtgaccctcggccgggcgcagtggctcacgcctgtaatcctggcactttgggaggccaaggcgggcgggtcacgagttcaggagatcgagaccatcctggctaacacggtgaaaccccatctctactaaaaacagaaaaaattagccgggtgtggtggcgggcacctgtagtcccagttactcgggaggctgaggcaggagaatggcatgaacctgggaggcagagcttgcagtgagccgagattgcgccactgcactccagcctgggcgacagagcgagactctgtctcaaaaaaaaaaaaaaaaaaaaaagtgaccctcataaaaaaattagctgggcacgatggtgcacactagtcggaatgctggggtgggaggatgacctgagtccgggagtcagaggttgcagtgggccgagatcgcgtcacagcactccagcctggcgacagagtgagaccctatcaaaaaatagcagcaggccaggcgcggtggctcatgcctgtaatcccagcactttgggaggctgaggcgggcggatcacgaggtcaggagatcgagactaccctggctaacacggtgaaaccccgtctctactaaaaatacaaaatattagccgggcgtggtggccggcgcctgtagtcccagttactggggaggctgaggcagaagaatggcgtgaacctgggaggcggaggttgcagtgagccgagatcgtgccactgcactccagcctgggagacagcgcaagactctagctcaaacaaacaaacaaacaaaacagcaacaacaacaacaaaaccatcctcccctcccgaggggacagaacagaaacgaatgggcgagtgccgggccaagcagtgggtctccagcaggtggcattaaaataggaattttggctggggacggtggctcacacctgtaatctcagcactttggaaagcccaggcgggcggtcacctgagggcagaaccagcctcgccaacatggtgaaatgccatctctactaaaaataaaaaattagccaggcctggtggtgggtgtctgtaatcccagcaactcgggaggctgaggcaggagaatcgcttgaaccaggggggcagaggttgcaatgagtcaagattgcaccaccgcactccagcctgcgtaacaagagcgtgtaactcttgtctcaaaaataaattaaataaataaataataaaaataaaaaagaatcttcattcatgggaagtcgagaacacatgaaaacaagtaaaggccgaagcgcagtggctcacgcctgtaatcccagcactttgggaggctgaggcgggcggataacctgaggtcggaagttcgagaccagcctgaccaacagggagaaaccccgcctctactaaaaatacaaaattagccgggcatggcggtgcatgccagtagtcccagctactcgggaggctgaggcaggagaatcgcttgaacccggaatgtggaggttgtggtgagctgagatcgggcaattgcactccagcctgggcaacaagagcgaaaccctgtatcaaaaaaaaaaaaaagaaaaaaaaaggaagaaaaggcctaaaggcgccgggcgcggtgggtcacgcctgtaatcccagcactttgggaggccgaggcgggcgaatcacgaggtcaggagatcgagaccaggtgaaaccccgtctctactaaaaatacaaaaaaattagccgggcgtggtggtgggcgcctgtagtcccagctactcgggaggctgaggcaggagaacagcgtgaacccggaaagcggagctggcagtgagctgagatcgcgccactgcactccagcctgggtgacagagcgagactccgtctcaaaaaaaaaaaaaaaaaaaaaaagaaagaaaggg

SEQ ID NO: 1923 - DNA, 1583 bp, Homo sapiens
ggatctgtgtggcatggtatgtgtgtttatgtgtattgtgggtgtctgtgtggcatgctgtgcgtgtgtgtattgtggatgtttactgtcccgggcagtagaaaggacgtcggggaagcagccccagcatcagggacaggccaggagtgcagaatgcatggaagctggtcaggtcggagcccgggatgaaggaagcacagagatgcaagggtgccagggcccatggaaccaagagccgatgatcaaggccacagtgcacacagccctggaggcaaaggacatattcatttcacaaggattaaaaagcatgggccaaggctgggccccaggccaggactggggatacagagtggatcagtccccatccctgcccccaggtgcttacccacacccattcacctcacaggtttccccaccccagccccttggcgagctcctcctcattcctcaaaacgtcgctgaggtcacgctccttcccgaggcctctccccatcctctaaaacaccctctccctgctgcccacttgcagcacagtcagagagctccgtggcctgtttccactggactgagtcttctggggggtgctggtgcagagcagaaccctgggctgggagtcccggcacctcgttccactccctcacccacagcctcgctgtttaacctcaggcaggccgtgtccctcctcagcctcactttccccttgtgtaaaatgagggaagggactgcgccttctaagtcatctttcagcttaaaacctctttgaccttctatctggctaatggaggtgctgaccaggggcaagaagggatttgaaaaacgctttgaaaaattcatagcaggaggcaaaggagaaagagtctttattttcgtagagcgggaggcaggaggagttatggacagaggctgtcgatgaaaaggacagcatctcagagcactttgtggcatttaatgtctaatgcctcctcccattaaagcagtggcatcaaatatttaccaaagcagcattaaaaattaacctttaccatggggatgtataaaggccctaagttccctgagaagtgaccgaacatcaggagggtaaagtgacaggaaggaaggctacaagcgggttgtgaataatggaagcccccaaaggtcccccaacacagctccctgttgaccccactcccaaagccagggcagcctccggccgtgtctctgcagaggctcccagcccttcggagactcccagagggcctgcaggataaggacaggccctcagctgggcatccacagccttccatggcctggccctgcctctctgggcagctgggatctgtaggatggaaaggaatgagtctgtcggagttggaagagaccaggggaggaagtggggagtggtccgggcactggaaatagcacgtgcagaggcactgaggcagagacagctgcacatcaatccatcagaagagcagccaggtggcatgagtgtgggggaggaaggaagcgcaggaggggacaggtgggagatgcaggtaggtctgactgtgcagggccatggtaagatgtgggcttctcggtccagggacaggggtgccctcgag

SEQ ID NO: 1924 - DNA, 4443 bp, Homo sapiens
cagagattatctcatcattgactccgagttgattggatggatgcagacagtatacagaagagcctttagagcttcatacaattgtgagctgataatctttcttagaatcatccaattggatgcacagtcaacaagcagccttctggtagttcattcatttgttcattcattctctattgagccttcaagcaccttcagtgtgacagatgtcacactaggtgctagacacacaaagataaattatgtttgtgcactgcttggagcagctcattccctcctcagaggttttgttgcagggtggagaacaggatggccagctgacaggtattccaggccctgcagctatgattttctgcactgtgatttaacaaaataacgctaggtgcaatcagtcactctcttgtgaattgcttagcaaagattattaccccagacagagtacactgagaaaaaataataaaaccctaggactggaccccaaactgaagacttcagtgaggaattgcctctttgtgacattccaccctatatcgtaacactgatgattcactttggaacctaaaagttagttacttttatgttcaacctacactcagcaattctactgcaatttgtgtctctccgtgttggctacctcttatgatctgcaatgccacatactactatcttcaggctgcaggctgagcctaggaactgagtctcagccatgctttccttccatcacccctcccatccccagctggcagttagtgttttgcaaatgatactgcaaatgattgtagtttgtgtttatgagaaaagggggttggtaaggaaaagacagaaagaaaggggattggggaaggggagagagagagaaagagagagggaggggtttaagctacttggaatttggagtttaagttgcccttaagtaaagcatatttttaataggctactataagaaacacacttttcaagggaaaaaaagtgggtttgaattttggctgccactcattagcaatattatctttatagggtaattatcatctccgggccttgatttttctaaactgtaaaatgaaatgtttggagttagagaatttttaaatattctggtatcattgattcttgtatttcttgagacaaaatcctctctttcacattctgctaattttgtaatttgtttcaccattctctcttgacacataaaaggactctgtgaaaactatcagtatcggagaagatttcctataaccatcatatcatctatgtttcctattagggcttctgacattccacatgttttcaaaggtaattggaaatactggagacaatttaagggtcattattgtgttagccaagaaaatagctaatgatgactttagctactgggctattcagcctatcatagagcccattagctcaattaagtaaatcaaataggaaaaaacatttagacttaaaaagccacccaccactacctattacttgcctgtgaggcttctatttcatggtgaattcaaattgcttgttcattgtaggtagaagaaaatgagcaatcatctgattcagcagatgcagtgattcaagatcacttagcatttataatgataaaccaaaaattatgttaaatagcaattttaaggaagcaggtaagactagaagccttctgcataaatcaggcttgagctttgcggaagtggcttctttccctgtactgaggtgtgagaagcagcacatggatttttattcctttaaaggattttcttcaagcaacagtctgtagttcaggttaatgggaaggcaaggcagtagcattgggatgaacatttatgatcccaaacattctaattctaggtgtctacagcattcaaatattgagtaggcacttacacttccaaagaccaattcttcaagataatgctgaggttaacttacagttttatatattattcaatggggcagttcacaggacatttgaagtgacttggagagaaaaaagaataccgccgttcatattattaatatttatggtacagttattatattcaggccatgctattgctggagagagttggtccattgaataaatgtgcaatgttcatgaagcagtgaatatatcattcaattaaaaattcagcaactgatgtagtcagggatgtgctggtaaatgtctcacaactggctttccaggaccggtttgcagcatttgctgattttcatggtgtagacccttccctcatggctgacatcaagctaccaatgggttggcatctggcttgcacaactgctggaaatttagcaatcaactcgagcacgctggcacaagttgctccagccccagtaccggacatgacttaaagagtgagggggtggaaaattacagtcaaagggggtccactacctacccaaatcctataaaacggccccacccctatctccctgcgctgactcctttttcggactcagcccacctgcacccaggtgaaataaacagccttgttgctcacacacacacacacacacacacacacacacacacacacaaagagtaaggggtgaaatggctttgcttgtaactggattccaagagaatcattcttagaccgcacacctaagtgtttactttattaccaactatcatctcaaagtgggagagaggatggggattgggtccccttttcagaaaacccctatgaaagagccctttagaaaaaggctgggcttgaggaagtcttaattctaaatatcgcggatcaggggaaggagcaggtcattccatttccttgggactcacatgtataataagcagatttcatatctgagaggcgtaagttcccttctatttttgctgctcagtgtgcaatttagtccaaaaattgactccggtgcagatcattaaattgtcaacagccagtgggtcctgaaacataagcaaggactacccagacaggaggtcgggagtttctaatgcatccccggggacctgctaggatcttgacctctctctaagagaggctttggactgattcggcataacagtgggggcagatctgctttctccaaggctgtctcttcccttctatcagtgatctccaccttgctcagcccactcaatgctgcctttgctgttacagtctaagaaatgtggctcctttttcctaacctctcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctctagggctatgatacatgtttcctatttccagatttttctttatgttctctctttatttctagaaaacacaaatagcttctcgcccatgggggggatttttggcaggaaaatcgcactctttacctgtcatccaccttccagaaatgcaggaactgaaagactgagaaagtggaaaacacgccatgcaattgctaacagttggcagagcagcaagtgcactccagtgggtggcatttgtccctgtttctatgctctgatctgaagcttgtacaacagatgtaccaggggctggaggatggcagtgctcatttgtggaggtgataatgctagaaaacagctcaggccatgactagcatagtgccacaggctgatgaacctgttggtcctgctgggcagttttagctcagcagcattttaaccatttgcaacgctagaagcaacggcaaacattgctaatgtaacatttctttatatggctagagtgctggaactagatgtcatggaacttttcaaaaatactgaggctttatgttcagttctgaataaaattttacctccaaattttctttttttttttgagatggagtctcactctgtcgcccaggctggagtgcagtggcatgatattggctcactgcagcctctgcctcctgggttcaagcaattctcctgcctcagcctcccgagtagctgcagttacaggcacccaccaccatgaccagctaatttttgtatttttagtagagacggggtttcaccatattggccaggctggtctcgaactcctcacttcaggtggtctgcccgcctcgacctcccaaagggctgggattataggcgtgagccaccatgctcagccaatttttattttttatttttcaaaattctattttattttaggtcctgggatacatgtacagaacgcaggattgttacataaggaaa

SEQ ID NO: 1925 - DNA, 604 bp, Homo sapiens
acctctcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctctagggctatgatacatgtttcctatttccagatttttctttatgttctctctttatttctagaaaacacaaatagcttctcgcccatgggggggatttttggcaggaaaatcgcactctttacctgtcatccaccttccagaaatgcaggaactgaaagactgagaaagtggaaaacacgccatgcaattgctaacagttggcagagcagcaagtgcactccagtgggtggcatttgtccctgtttctatgc

SEQ ID NO: 1926 - DNA, 4442 bp, Homo sapiens
cagagattatctcatcattgactccgagttgattggatggatgcagacagtatacagaagagcctttagagcttcatacaattgtgagctgataatctttcttagaatcatccaattggatgcacagtcaacaagcagccttctggtagttcattcatttgttcattcattctctattgagccttcaagcaccttcagtgtgacagatgtcacactaggtgctagacacacaaagataaattatgtttgtgcactgcttggagcagctcattccctcctcagaggttttgttgcagggtggagaacaggatggccagctgacaggtattccaggccctgcagctatgattttctgcactgtgatttaacaaaataacgctaggtgcaatcagtcactctcttgtgaattgcttagcaaagattattaccccagacagagtacactgagaaaaaataataaaaccctaggactggaccccaaactgaagacttcagtgaggaattgcctctttgtgacattccaccctatatcgtaacactgatgattcactttggaacctaaaagttagttacttttatgttcaacctacactcagcaattctactgcaatttgtgtctctccgtgttggctacctcttatgatctgcaatgccacatactactatcttcaggctgcaggctgagcctaggaactgagtctcagccatgctttccttccatcacccctcccatccccagctggcagttagtgttttgcaaatgatactgcaaatgattgtagtttgtgtttatgagaaaagggggttggtaaggaaaagacagaaagaaaggggattggggaaggggagagagagagaaagagagagggaggggtttaagctacttggaatttggagtttaagttgcccttaagtaaagcatatttttaataggctactataagaaacacacttttcaagggaaaaaaagtgggtttgaattttggctgccactcattagcaatattatctttatagggtaattatcatctccgggccttgatttttctaaactgtaaaatgaaatgtttggagttagagaatttttaaatattctggtatcattgattcttgtatttcttgagacaaaatcctctctttcacattctgctaattttgtaatttgtttcaccattctctcttgacacataaaaggactctgtgaaaactatcagtatcggagaagatttcctataaccatcatatcatctatgtttcctattagggcttctgacattccacatgttttcaaaggtaattggaaatactggagacaatttaagggtcattattgtgttagccaagaaaatagctaatgatgactttagctactgggctattcagcctatcatagagcccattagctcaattaagtaaatcaaataggaaaaaacatttagacttaaaaagccacccaccactacctattacttgcctgtgaggcttctatttcatggtgaattcaaattgcttgttcattgtaggtagaagaaaatgagcaatcatctgattcagcagatgcagtgattcaagatcacttagcatttataatgataaaccaaaaattatgttaaatagcaattttaaggaagcaggtaagactagaagccttctgcataaatcaggcttgagctttgcggaagtggcttctttccctgtactgaggtgtgagaagcagcacatggatttttattcctttaaaggattttcttcaagcaacagtctgtagttcaggttaatgggaaggcaaggcagtagcattgggatgaacatttatgatcccaaacattctaattctaggtgtctacagcattcaaatattgagtaggcacttacacttccaaagaccaattcttcaagataatgctgaggttaacttacagttttatatattattcaatggggcagttcacaggacatttgaagtgacttggagagaaaaaagaataccgccgttcatattattaatatttatggtacagttattatattcaggccatgctattgctggagagagccggtccattgataaatgtgcaatgttcatgaagcagtgaatatatcattcaattaaaaattcagcaactgatgtagtcagggatgtgctggtaaatgtctcacaactggctttccaggaccggtttgcagcatttgctgattttcatggtgtagacccttccctcatggctgacatcaagctaccaatgggttggcatctggcttgcacaactgttttttatttagcaatcaactcgagcacgctggcacaagttgctccagccccagtaccggacatgacttaaagagtgagggggtggaaaattacagtcaaagggggtccactacctacccaaatcctataaaacggccccacccctatctccctgcgctgactcctttttcggactcagcccacctgcacccaggtgaaataaacagccttgttgctcacacacacacacacacacacacacacacacacacacacaaagagtaaggggtgaaatggctttgcttgtaactggattccaagagaatcattcttagaccgcacacctaagtgtttactttattaccaactatcatctcaaagtgggagagaggatggggattgggtccccttttcagaaaacccctatgaaagagccctttagaaaaaggctgggcttgaggaagtcttaattctaaatatcgcggatcaggggaaggagcaggtcattccatttccttgggactcacatgtataataagcagatttcatatctgagaggcgtaagttcccttctatttttgctgctcagtgtgcaatttagtccaaaaattgactccggtgcagatcattaaattgtcaacagccagtgggtcctgaaacataagcaaggactacccagacaggaggtcgggagtttctaatgcatccccggggacctgctaggatcttgacctctctctaagagaggctttggactgattcggcataacagtgggggcagatctgctttctccaaggctgtctcttcccttctatcagtgatctccaccttgctcagcccactcaatgctgcctttgctgttacagtctaagaaatgtggctcctttttcctaacctctcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctctagggctatgatacatgtttcctatttccagatttttctttatgttctctctttatttctagaaaacacaaatagcttctcgcccatgggggggatttttggcaggaaaatcgcactctttacctgtcatccaccttccagaaatgcaggaactgaaagactgagaaagtggaaaacacgccatgcaattgctaacagttggcagagcagcaagtgcactccagtgggtggcatttgtccctgtttctatgctctgatctgaagcttgtacaacagatgtaccaggggctggaggatggcagtgctcatttgtggaggtgataatgctagaaaacagctcaggccatgactagcatagtgccacaggctgatgaacctgttggtcctgctgggcagttttagctcagcagcattttaaccatttgcaacgctagaagcaacggcaaacattgctaatgtaacatttctttatatggctagagtgctggaactagatgtcatggaacttttcaaaaatactgaggctttatgttcagttctgaataaaattttacctccaaattttctttttttttttgagatggagtctcactctgtcgcccaggctggagtgcagtggcatgatattggctcactgcagcctctgcctcctgggttcaagcaattctcctgcctcagcctcccgagtagctgcagttacaggcacccaccaccatgaccagctaatttttgtatttttagtagagacggggtttcaccatattggccaggctggtctcgaactcctcacttcaggtggtctgcccgcctcgacctcccaaagggctgggattataggcgtgagccaccatgctcagccaatttttattttttatttttcaaaattctattttattttaggtcctgggatacatgtacagaacgcaggattgttacataaggaaa

SEQ ID NO: 1927 - DNA, 872 bp, Homo sapiens
cttcaaaaggcaaattctctatttcccccactttgattatctgcttatgctcctaaaataatgtaaatatggtcattaatcatctacaacattgtcaattaggagagtaaagccagtaatgaactctacatccctgacctcatatggtatgttgcattttaagggagctgtttttatcaatgacaatcgtattatttgtgctcataacctgggctctacatccagtgaaaggattttgatacagaatctttatttgaagagaactacacaaaaacaccatcaccatcatacctgatgtctgctattgttgaaataggcttcagcactgtagctggtggaaaccaggtcaccaaagacactgcccttgtacctggaaggcccgtccctgcccccattcacacagtgaattcatttagaagagaggaatgctgtagacagagtcattagaaaacccttcatgactgtggcgtggaaaagggctggcaaggatcacaaacagctttcctgggtttggtcttacagcatggacttcttcaccctcatctacacgtaaaatttattaacttcaaggagaggagatcagggttgcctctaccttgcattcctatgtagccatgaattaattcccaaatgccagtgtgagcctgttttccttttcatacatcgtatttgaggaaacagctggaaatattactctgtgtgccacacatcccgattcagcacagtctcttgttcccagagtggagtaaatgagtaaagaaattattcatccgccttttacctaacttggtgtgtgaccaataaattctctcaagattgattcaggttcctatattcatggaaacaaaaaaagaaaattgggcagaaaataa

SEQ ID NO: 1928 - DNA, 2128 bp, Homo sapiens
tctacctccgggctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccatggggcaccccatggtggtgcgtccttgggagcagctctgtccctttccccgtggcctttgccccgcctcctatgacttcgattcccacctgtccccgacccctgggaccactgaccgggcccgatcaccctgtcactgccctgtcatctgcttaccccacacggtgctctgctgacccaggtcttgctgtctcccaacagccccacgaggcttcccgtcgctcctggacactgcaggctgagcccgctgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgagtcagggtttatatgcaggtgtctacaggagacatgctgggttctgtgctgggtgtgaggaatatgggagcagaaccccagggaggtggcagagacttgggggccaaagggctggggtgcaggggggcaacagccaggtgccactggccaccccagccgcagggagccctgcccaccctccaggtgcctggatgtccaacctcactgctattcccacctcaagccaggcctggagatggaggccccatgactcagccagggccggtttgcagctgcggctgacccagacgggcgggcagcccccagcccccgggcctgcacccaggacagggccgccctccctccctcccccgcttctggctcctaggacaggattctctgaattcagctcccctgaggctggggccaggttggaggccaggcctgggggctctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaggcccatctggggcttgggggtgtctccccaactctcagacataaggacacccttccaagcttgttccttcacctggcggggccctgagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgaggg

SEQ ID NO: 1929 - DNA, 2129 bp, Homo sapiens
tctacctccgggctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccatggggcaccccatggtggtgcgtccttgggagcagctctgtccctttccccgtggcctttgccccgcctcctatgacttcgattcccacctgtccccgacccctgggaccactgaccggggccgaatcacctgtcactgccctgtcatctgcttaccccacacggtgctctgctgacccaggtcttgctgtctcccaacagccccacgaggcttcccgtcgctcctggacaatgcagggtgagcccgatgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgtgagtcagggtttatatgcaggtgtctacaggagacatgctgggttctgtgctgggtgtgaggaatatgggagcagaaccccagggaggtggcagacacttgggggccaaagggctggggtgcaggggggcaacagccaggtgccactggccaccccagccgcagggagccctgcccaccttccaggtgcctggatgtccaacctcactgctattcccacctcaagcaaggctggaaaatgaaggcccactaatccgccaggggcgggttggcacttccggttaaccaaaacgggcgggcagccccagccccctggcctgcacccaagagaagggcggcctccctccctcccccgcttctggctcctaggacaggattctctgaattcagctcccctgaggctggggccaggttggaggccaggcctgggggctctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaagcccatctggggcttgggggtgtctccccaactctcatacataacgacacccttccaagcttgttccttcacctggcggggcccttagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgaggg

SEQ ID NO: 1930 - DNA, 2132 bp, Homo sapiens
tctacctccggcctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccacggggcaccccatggtggtgcgtccttgggagcagctctgtccctttccccgtggcctttgccccgcctcctatgacttcgattcccacctgtccccgacccctgggaccactgaccgggcccgatcaccctgtcactgccctgtcatctgcttaccccacacggtgctctgctgacccaggtcttgctgtctcccaacagccccacgaggcttcccgtcgctcctggacactgcaggctgagcccgctgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgtgtgagtcagggtttatatgcaggtgtctacaggagacatgctgggttctgtgctgggtgtgaggaatatgggagcagaaccccagggaggtggcagagacttgggggccaaagggctggggtgcaggggggcaacagccaggtgccactggccaccccagccgcagggagccctgcccaccctccaggtgcctggatgtccaacctcactgctattcccacctcaagccaggcctggagatggaggccccatgactcagccagggccggtttgcagctgcggctgacccagacgggcgggcagcccccagcccccgggcctgcacccaggacagggccgccctccctccctcccccgcttctggctcctaggacaggattctctgaattcagctcccctgaggctggggccaggttggaggccaggcctgggggccctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaggcccatctggggcttgggggtgtctccccaactctcagacataaggacacccttccaagcttgttccttcacctggcggggccctgagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgaggg

SEQ ID NO: 1931 - DNA, 4410 bp, Homo sapiens
ccacccagggcctgagtcctgtccacaccccaggtgacggccggctccacaaggcagtgagcgtgggcccccgggtgcacatcattgaggagctgcagatcttctcatcgggacagcccgtgcagaatctgctcctggacacccacagggtgagcaggccaacgaggaatcctggcagggtacttggggggtgccctccattagcaccaagcagtccccacccagcttctcctcccttgcctcaggaggatggaaagataaaggatccagtcatgaactattagaaagtggggtcgcctgttacgtaacaggcctcttgggggtggctctgggaggcatacaagccgggtggccatgggtgatggccctggctgcccatgcccgcttctcatccccgtgtctggctgtgcaggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggtgagcactcccaaaggccccttcccatctgtccagccctgcacaggtgacctcggagcaccatcctgggccctccttgggaccgccacacagcctcgtttatgtccactgtctcagcataattattaattagctctcctgcttcctctcaagtgcaattcagacaggaaattgtgtgtttatcttggctacctgtaaaacgaggacatgatttggtaaagtatgaaatagcacagctttgaaaagccttgcaggaaaatgtggattagcgtgtgaacgtgctttagtaatagtagggctaggaaacagtccattaacaaacccagtaaaaattggtttcagaataacctatttggattataaaatgttcatttagaaaatagggatgaacacaaagcaaaactacccctcatcccaccacctagagagaatcgcagtgagattttgatatattatcctctcaggttttactacatatgtgtatagataacaaaaatccttttattttatttcatttcatttcatttatcttgtttggagactcgctctgtcgcccaggctggagtgcagtggcacaatctcggttcactgcaacctccacgtcctgggttcaagcgattctcctgcctcagcctcccaagtagcagggattacaggtgcccgccaccatgcccagctaatttttgtatttatagtggaggcagggtttcaccatgttggccaggctggtctcgaacttctgacctcagatgatccacccaccttgggctcccagagtgccgggattacagccatgagccaccgcgtctggccaaacattcatatattttatataacattggcaactgtcctgtttgtagtgttcttgcttcacatatggatacacctggtgtcagtttttacaaaaaccaagtgagttttggtgcgtatgccaggagggacaccccagaatgttaactgtcatgatcactggctggtagatgctgtgatttttgtagtgttttcatccttcgtgcctggttgacttatctgtctcctgagtgtatccagaattactgtcctttattttttattacacagatgtatgcatgtgcactgtttaaaaaaaaagatgagaacacatcaaaaaaaattttaattaaaaaaaagaaaaagagagatctatacatacagatcccagctgtccttctaatctttttctgagggtacatactattttttattattattttttgagacagggtctctctgtgttgctcaggctggagtgtagtggtgtgattacagctcactgcagccttggcctcctgggctcaagcaatcgatcctccaacctcagcctcctgagcaggtggaaccacaggcgtgcgccaccatgcctggctaatttttctattttttgtagagatggggtctcgctatgttgcccaggttgtcttgaattcctgggctcaagcgatctaccggccttggcctcccaaagtgctgggattacaggcgtgggccaccatgcctggccactgagggtacatactgtttatgtaattaagggaagtgttatcttagctttgacttgaaataatgtgtagacagaggagatgctgactcctgtgggtggggaatcagctcaggaaaggcccttgcccaggcccaagtctgcagtgaggggtgagggaatgtgagctcaggggacttcctggccaatcccagaattctctctggccctcaggccgtggatccaggacatcgagggagccagcgccaaggacctttgcagcgcgtcttcggttgtgtccccgtcttttgtaccaacaggtgaggtgccccctcaaaaggtggaggagagaggtggggacaagtgtgcttggaaggctcccccaggcacagatgttgtaaatgcctttcctcacttccttgccccctacccctgtaagcaggtccccaggaagactcagtcccaggggtccccggagttgcccatcgtggcaccaggggcatagccagagggaggcaggggagcttggagctactgtggacgctggcacccccctaccccatgccttttctgcctacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctcgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 1932 - DNA, 1251 bp, Homo sapiens
tgcagtaaaatagactttactgatgtacggttctttacattttgatgcatgcagagactcatctaaccaccaccccaatcaggatacaggcgagtcccacacctcctgctgccccttcatcctcacaccctcccacggggacagccagcgtgggtgcggcttgacttcccgctggcctctgctcgatatgctgcttattcctaggatgattgaaggctcttagaagagaagtccagtccttcctcataccagtgtatctcatgtcacacatagggtcaaacttctaaacctttattactgattagtacaaacacaaacggagcaatgacaacagcagtgaggagaggccctgacaacgagggccgcccctgcccggggtgaggctgcacagcgccagctccaggctgggccagcttggcgacactggcaacacaggcttgaccttggccacagctcagcagtagaaaggttcttggacagggtgccaggacacacgctggggctgctgtcacaggacaatcttaaaggagctgaacaagagaaaagcggtgggttttctgctggaagaggagggcagggactaaacccgaacttgcccccttctccctttagacccttctttggaacgggctatgttccgtgtgtcagccccctctgcaagaactccccgagacatccagagggagctttctggacccacacactgggtcagagcttctaaacctttattactaatgagtacaaacacagagcaatgacaatggcagtgggaaggggagaggtcttgacaaggagggctgcccctgcccggggcgagactgccagcttagccggccctgtgtgtggggactggggctttctctcaccctggcaccacctcctgtagccatgccctaggcccagaggcagcaggtcggaacctgcaggtacccagaatgaagggggaccactgtcatacctggcaaagtctggagaacgggagatgacgtgctggaactcagagaggttgatggttccatccctgtcaatgtcagactcctccaggatctgggaaagggagagtttcaggccagagccccaactgctccctcccgctcccaggcctgctcagctgctcacgttgtcgatgagctgcttcatctcagacgcactaagccgtgtgtcctcgccctctcccgtgaggcagttcaccagccggctcaggtcttctctgttcaaggttccgtcatcatcaaagtctagagagcagac

SEQ ID NO: 1933 - DNA, 2371 bp, Homo sapiens
tatttttatgtgttttacgtaagtgcatgtgtaatttattgatagcaaggtttgcatgcatttattctgtgaatcagctcgggctggacttcctgggaatcccaggcgaagatctcagggtctctttctgctgatggctctcccttccacgaccggtcccttcccttccctgggcttcaatttccacgttggtaaatgaaagggttaagctatttctacaatcccttccttcttgggcattgttgattcctgggaagccctgacgaagagagaggacggtaagagtttacctaaacgtctctgcaccccatgcttgaaaactcaaagatcagccccgaagcgtccatgaatcctgggacaaagaaaaggacttcaaggcctcatacctatcaacaagagagattcctgctcctccagcccctccaccccttcacttttgtgctgaggaaccccccatcaccaggaggaaggaagcctgcccagtaaaggggcactcccaacagcccaccagctcctgcgcccagatgcccctgaaatcctcggactcattttgtccagcagccttgactttgtcaggggtaccagtcatgtaatccctgaggtgtctacaaaaccccgcagtcatgggctccatgcacactcaagaacaatgaggagcttcaaaagctaaggaggcttttcccaatgcttccatggtgtctcgatggttcctgaggtcttgatactctgccatggcttggcagtttggaaatggtttcctggtctggctgtcctaaggatccctggttgtgtgactgggaacaaacccttcaaccttccaggcacagttttcttctgtaaaatgagagggttgggtgcaagtttcctgaggccctggggccttgtggctgagtttatctccccgactccctgtccatcctcctatggaagtactcataaagcatttcacagccacaaggaaaaggcacacaaggtcccccagcccccacacacacaggagccacacctgcacccctccctcaaggccaggcttcctctcccccagcacacgcaagttcttctcggcctcccagctcttttcagcagctccccagaatggaacggcccagccatggcttctcagaggacagcttcttggcagagctgggagtgggtggagtagagcacattttttcctttgaggtccaaagggctgtcaaccctcttcagctgccctggggcccaacagccacagagagagatttatgacctggatagctttgatcccagtctccgataaacatcaggaacagctcgaccctaaaccccgaggagaaggtttatggatcagaatgcagcctcctggagaaaacgagcccaggagggggtgcccagggactgattgggcccttaaagttctctcatcaacagacccactgccatctgcccttgctttctggggagagggacacagctgggtggctgaggcctttgaacaagaagcaatgctgatcagagagaggtgaagatcctgtcaaaggttaaactggggaaggggtggaggcggtgggcccaggcctctgaaattccccaccctcgctcacctgttcttccaaacagcgttgtccatgtttctctaaaccacacaccaagacaaagcagagagagaacgcaccagataagatctgagctgagaaaggaatgtttcatccgtgggttttgttgtccctgttcttcttgttgatactgttgttcttggtgatgatgggggtggttaattgcttgattatatttcatccctgtcttctttccaaaaggacagggggccaggagagtctgtgtggtcacaaacccttcatagctttttcccgtcccctccacttgaccatgtgggatggcagggaatccacaccctcttggaacatcccctgttttgctgattgaaaagagatcctagaaacagcactacatccaaggtgaaggaggggccagccagtctcctctggatgccacctcagatgggttgcctcaagtttaaggtctcagccacatccataaaactgttcccctctgtgaagcaacttctgccatggggaggtggagaaggatcttctcaaagcaagtccgacaggcagagtcttcactctccggggtccggagtgttctatagacatcgggaaacatacatccatctaaaaagacaccctaataaacctgcagctattcattgcacccaagaaaccagcctgtggcccacgcatgcaggaataaacacatatttgctgagaaccaaattgggtctaatgaccctggcctgtctcgcagggtcatcctgagaaatagctgatgtcagacgacgagcgtgagcagctgttctccatttgcactcaac

SEQ ID NO: 1934 - DNA, 129 bp, Homo sapiens
acgcctgtaatcccagcactttgggaggccgaggcaggcagatcacgaggtcaggagttcaagaccatcctggctaacatggtgaaaccctgtctctactaaaaatacaaaaaattagacaggcgtggt

SEQ ID NO: 1935 - DNA, 2649 bp, Homo sapiens
cttgtaggtactcattgaggtttattgtgtaagatgaatgaatgttgcaaattcctaaacatgtgattcagatgcccaatcttactctgttactttatgaaaattttttaaagctatatgatgttatatcaaaatatgttgttatactttaggataatcggtgtgttagccctgaatttcagcataagtcccatttttttccatgggagtctaggaaagctatatgtttattcagcagcaaaatacagtttggaacttaaataaactattgatcaatttctggtcttatgctagaaggaataaagcatcaagaaaaagaaaagatttgctgtcaagaccaggaaaatttgacaatagagtattagaatgcaggaaatgaggggaagtggaaaggcagcaagtaggagagaaaaagtgcagggacagtagaaagtgaatgtaggagctttctgacccatgcacttcaggaacgcaattcatccctaaaatgctgtttgctgtcttaggttgcaagtaaccaaattaaaaccagtttgaaagtagagtgagacagctgtcatcataagagtcatttgatctgtttaaaggtggctgcttgtatgcagggaccaacagtcatgttcagggcagcagctggtgcacacttcaagcacagaccataagagctaccccaggcagcacctgctaccaatagtgcaaacaactcagagagacctcgttggcataagggaatactctatcctttctgagtaaagagcaagtagaactaaaggtttcacattttaaacatactttacattcctcctcttctggggctcaagcctacttttgggccaaagcggatgttatatctgacatagagtcctcggagcagcagttgttcctgaaagttcctttttgcatctttgtgcctcatgcagtggcttacaagtcaaccagacttctcccctgacttttgatgtgtaagagcttgtgtttcaaatgggtttggttttcttaatgtcaccctaggttggtggaaaggagagtaaatggaaatggggggagcagggtcccctggggaggtttaaacagatggaagtcaattgtctcttgagaatagaggaggctattgagttttcattccacactctgctcctgttctgtcagcaaagaacaagcactactctccagcaattgctttccactggactcccccacctcggcctccctacaaaaacctagggatcaacttagttcactccaaattagaaaatttaatagtcatttgtttcttcttgtccacagggagaaccattttctttccttctttcaaaattgcccaggtcttgtgaagggttattaacaccggaaagaaatacattttaataagcttaaatctcatttctacatgaaaccatcagattttagtactgtgatattttggtccctctgtcttttaggctctgacaccaaaattgccataatgaaggtgtttcacttcttctcatttatttttatgggatcttttattcccaaatgccttttcatcccagccaaagggagaaatgttgatagatctgccatcaagaaggttccaaagctggcctgtcaggttttctgttttcttgtttattatctttgaacttttgttttaaatgttttaaacacttatttaccatgtaactaaatgtctgatagtattgaaaatactttgtgggttttaatttatttaatgctcatgaaaccctatgaggtaggtactgatattatttttattttactgatgaggaaagtgaagcaaagagaagtgaaatgaaaggtagtgagtgatgggaccagggtttggacatgggcagtctggctctaaaatgtatgcttttaactactatgtaatgctgcctcacaaacaacttgtctcacaaattgatattctggatcagaggatgtcgactggcccgcaaatgtattttgtatggctcatacacagttcagaagttttaaaaatttacatagaaatctgcatttcctgacttcttttgaaaatgggaataccaaacatcattaggcttgaattcccaatacggcaacaacagctgagcaacaagcagctgtttagactaggcactcgctctccaatttccacagtccccaccaatgcagatcatagtatcgacttaaatttcctgcctgccttagagaagcttctgagcttgtgacctctattctagctgctctatgaatggacgctgccccagtacagcgaggacctgctgcaaaatgcatttcttagtcttcaatacttattcctccttgtaactggatttctggtaagttatgtctcatggtggatctgccccaaagatggagactgaatggcagtgagtcactcgccctggcctccattgttctggagaaggttccagccacatggttgatgtcagctggttttccagagccagagctgggttgcgggacagacacacctgcatctaatagtgaaaggcaaagttgaaaggccaagaccagcctgaggtctgagggaccaagggcttcacagaggccagaagttcagaggtggacataaaaggtgttaggagaataaggaagtgaaaagaacatagtacagtgtatcagaggaggagctccaggctggcaaatatcactccc

SEQ ID NO: 1936 - DNA, 2649 bp, Homo sapiens; identical to SEQ ID NO: 1935

SEQ ID NO: 1937 - DNA, 190 bp, Homo sapiens
atgagaaagtaaacatacaacacagtaaaagttgttccaagtatttaaaaatgttctatatcttctaccttattatggctcaagatatagtaacttttgtggggttttatcattgtttttgttttattttgtgaaaacatccaagagcccgcaacagcctatagatttgcagatccttttctttcctggg

SEQ ID NO: 1938 - DNA, 190 bp, Homo sapiens; identical to SEQ ID NO: 1937

SEQ ID NO: 1939 - DNA, 13077 bp, Homo sapiens
atcccatttgaagtggtggagaaagtttacccaccagtgcctgagcagctacagctccgaattgctttttggagcttccctgagaatgaagaggacattcggtgaggccaaaggactgatggtggggagcggggtcctgatactccacactgtctgctgggtttcccatagaacaaaggagacattgtatttggggcagtggtaagaggaagacaagggagggattgcctgggattccactccctcccccccaccccccgccctggggaaggaatgaggctagggagagagtgcctagggcattgtggtctctgacagggtctgccaaaggttatttgctgagttgtggctgtgtcctcttcttcacccccaggctgtattcgtgcctggccaatggcagtgcggatgagtttcagcgaggggatcagctcttccgcatgcgggctgtgaaggacccattgcagataggtgagtgggccatcatgccatgtggcacatcctgctcctcccatcccctggcttatgaagtaagaacacaccgcaagaagctggagcatgttgtctgaataactgcagggccagggtcaagggcagagacccaggtcctgacagcactccctgaccatgcccccatttctccccagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgtgaggccctcccaatttatcccggccctatcctacactccatcccccccttctctgctgcatgcctggctacaatgtgagccccctcgcctcgcctactctgcctctctgtcccccagctccagctccagcaaacctgttctcagattgttccatttttctctgtgtccccttcaggcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccgggtgagtgtggtgagaaagattggcagtaggaagaaagccagcttgtagtacagagcgccatttactcaaggcttgctgttgtcaggcaaatccaggcccctatctctagatgactgactgcctgtcatcctcagaccccacagcagggccctcagcatcggaccagagtacttggtatctggatgaatcgacactcactgacaacatcaaaaagacactgcacaagttctgtggcccctcccctgtggtcttcaggtaaatcggatctctgcatacctgtgtctgtggtggagggggagcgtccctcaggctgatgacagatcctttcttctattcatgcctgtgacccctaccttttattccctgaactggcacagtgcctggcacacagttgtcactaacgaattgatggaagatgatgaccttgtacagtcacagagtggtctgctcttacctagcaagagttccttttcttcttttgatagatcaggaaatggaaacagagaaagattttttaaagagtttttgtggctgggggcggtggctcatacctataatcccagcattttgggaggctgacgtgggcagatcacctgagatcaggagttcgagaccagcctggccaacatggcgaatctccatctctactaaaaaaacaaaaattagccaggcgtggtggcgggcgcctgtaatctcagctacttgggaggctgaggcaggagaattgcttgaacccgggaggtggaggttgcagtgaggtgagatcgcgccattgcactcaagcctgggcgacagagcaagacttggtctcaaaaaaaaaaattttgttacagatgtctttttccctctatcttctgtattttggggccggaagcccttttaggtttcattcagccccgtcttactgtcatggttttctgttcctctgcttttacagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacaggtaatcactcagcgttggggagccccgtggtagctcattctttccctccccctgcctcatcctcctcttgctgaaatggactctgggagggctactctgcctttctctgagctctcaggtgcagctcacagccttctttgtctccagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggtgagtctcccctgaggctcaccacagaactgagcctgggccagctcaggacagactgagccttcatctccttgtttgcagagacataccatgattttagtcctcgggaaacgggaggtgctgagcactggtgttagcagtgatttacgagtcctttttctgagaggctttcatccttccttcccctaaataacacccacttttcaaaattctccagtgtttcagtgatgcttatggggctgggtcaagaagtactttcctgtatcctttccccatgcctctctttggggtgtacacctactccatgcccatcctttcccagtagcccctcagcagcctcctgccccttgttcccacaggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtgaggggatggaaggagggagggctgggtgctccttagccacaactgggaggggctatctagctctagttgggagtgtcaggaccatcagcaggattgtgagaaccctgttgcaggcgccgaactggtctccctgctttcagtctactcacttttctgcttccacgagattttcctgaaatgtgatggtgtcactctgctgcttaaaacccttcaatgggttcctgttgcccttatgataaaatgaaagtggttggcatgacctgtgagggtccacttgatctggtctttgcctgctttgccagcctcacttggctgctctgtcctttgcactccagtcagctgaatcactcatgtatctgccatgctctctctcttgcctccaggattttggacagattgacctttctgcctggaatgctcttccccattagcccgtgtttctccttcaggtctcagggatcttaaagatcacttcctctagggagtctctctgatactgtccctgtgccccaagatatcccacctgcttccccttgacctttccctgtaatagctggcatcacggtggcatgtgtgtttatgtgtctgtctttctaaccagagctcctatggagcggcacagggcctggcatgtagcaagtgttcaaggaatgttggctgcatgagtgagcatgatgtcctgctcctggaagttgggactttaacctgtctggtcccatgtcctccttccaggtactgtttgcctgtgctgaggccctgcatgcgcatggctatagcagtgaggcctcccgtctcactgtggagcttgcccaggatctgctagccaacccacccgacctcaaggtagagccgccccctgccaaggtgagagacccccttcctctaccttcccctcccccacttacccccaacctgctcccatgccccaccccaagtgagagcatccttctacctccaccaaggtaagtcagaatcatctgcctgtctcctgtgtttcttccctttctagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtcagaggctccatctcagccttgtatttcagtctctttagagccttgcaccttgatctctattgacacaccagaggtctgagctccttcctgtgccctcaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagtgcctgtaagacaggaattcagggcaaaaatgtgtgctatatggctgggcgtggtggcccatgcttgtaatcgcagcgctttgggaggctgaagcaggaggattgtttgagctcaggagttcatgaccagcctgggcaacctagcaagacctcatctttacttaaaaaaaaaaaaaaaaaaaaaaaaaaaattagccaggtgtggtggcacatgccttgtgctgccagctactccagaggctgaagtgggagaattgctttagcctggagattgaggctgcagtgaactgtgattgcaccactgccctctagcctgggcaacagagtgaaaccttgtctcaaacaaagaaaaaaaaaattgtgtgctatgggtattgggtattgtaagggcagcaaaacaaaaatctagagaaaggcctaagggaagtggtagaatatggaatgtgggttaaaagatcagtaggtcctaaaccagcgaacaccatgagtaaatacacaacgcaatcaagttttcatgagaatgaggaggccagcttccctaaaatgataagtacatgctgggtaagcagattggacctggttatgaaggttttgaaaagcacaccagagcttaggctggatataatagtcaacgaagacttctataggtgatgtgggttggaccaagggaaccccttacttcatatgctgatggcttgggaaccctggcctcttacctttgctgtcttgggaattatgactactctcaatccccataaggtcctctttctcgcaggcatgaagacaacagtgagcgaggcagaacatcccctcttatgtgaaggcacacgtcgggagaagggtgacctggcattagcactaatgatcacttacaaggacgaccaggccaagcttaagaaggtaagagactggggctgggtgcggtggctcatgcctgtaatcccagcagtttgggaggcagaggcgggcagatggcttgagcccaggagtttgagacaagcctgggcaacatggcgaaaccccgtctctaccaaaaaatacaaaaaattagcagctgggtgtggtggcacatgcctgtagtcccagctactcgggaggctgaggtgggaggattgcttgaacccagtaggcagaggttgcaatgagctgggttcacgccactgcactccagcctgggtgacagagcaagaccctgtttcaaaaaaaaaaaaaaaaaaaaaaggcaaggtactggggcctttgacaggcagagaaagagagcacattttactacctttctcagggagtttccagtacaatgagaaaagtgctattttaggctgggtgcagtggctcatgcctgtaatctcagcactttgggaagcagaggcgggaggatcgtttgagaccaacctggccaacatagtgagaccctgtctctacaaaaaattagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaagaagaagaagaaaaaaagaaaagtgctcttctgcccataggaggtaagtagggaatcttggggacatctcataaagaataagagaagaccaatggttcttataggagtgcttgggcatggggtggaagaagagaagcagagggcataaagtcattcattcacttatttcagtatttattgactatcagtatattctgccctgtggtgttaatggaggataccaagatatgttggggttaaataagttacaaaaagacatgtaaaccaggaggtcatcctgtggttgtaagtggggaaggctccctgaggatgtagcaattggctgtttcaaggagaaaggaaggtaatagaagtcaggagctaaagggcatcctgtcactgcttctctggaggtcactgcttctgtcttccagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctggtgaggtgggggcactgggcaggggggatgaatggtgtggacctatgttgaggtcccctttcctgggctcatcccagcgtcctgttttcctcacctagagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggtaggatagcctgtgggctagcatagagggaaggataatcctgaaggttggagtcttaacatctgggactcctgacttctgagactgacttctcttgggggttaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtcagtgggaagaactccccatcttccctgatctggcccaccctcagagccacacccctagtgcaatccaaccattgtctcccagcatcctcactttccctggtccttcccaacctacccggatgcccatttcaaagaaaccccaacccccgtccctaccccattgccccttcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggtaaatcatttgacctgacttgggtatgggagggggattaattggtggggataagacccttatctttgtggggttactgatctgataaaaagacattattctcacaccccagtggtgcccacactaacccaactctgcccttctctcctttcccctaaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggtatttctacgggcaatctgggaacctcttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacaggtgaatggaggggaggcacactgggcaggggaggtggggagggaatgttctttgtctctctttgggctctgagttcctcacatggctctcaccccacttagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggtgagaggacatccctttctgtgctcctacctgcagttgtgccagtggctcttgcagaggacccttcctctagctcttcatttgtttactgtggggtcaggtgacaggttggggtaaagggtgaagaggatacaccgtaccatgtgcccacccttatctatctcccaggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggctctctgccaggccagagctgagatctgtaagttgggtccctagggcagaggtggccacccccgtctcatgcccctccccctgccccccaggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcaggtgacaacctagaattatggagcagggtggagcacttcctgggtggtcttggaccagagggaggcagggcctgtttctgtgctttgtactaaggctcatcctgcacacatcctcctccagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctagtcga

SEQ ID NO: 1940 - DNA, 13076 bp, Homo sapiens
atcccatttgaagtggtggagaaagtttacccaccagtgcctgagcagctacagctccgaattgctttttggagcttccctgagaatgaagaggacattcggtgaggccaaaggactgatggtggggagcggggtcctgatactccacactgtctgctgggtttcccatagaacaaaggagacattgtatttggggcagtggtaagaggaagacaagggagggattgcctgggattccactccctcccccccaccccccgccctggggaaggaatgaggctagggagagagtgcctagggcattgtggtctctgacagggtctgccaaaggttatttgctgagttgtggctgtgtcctcttcttcacccccaggctgtattcgtgcctggccaatggcagtgcggatgagtttcagcgaggggatcagctcttccgcatgcgggctgtgaaggacccattgcagataggtgagtgggccatcatgccatgtggcacatcctgctcctcccatcccctggcttatgaagtaagaacacaccgcaagaagctggagcatgttgtctgaataactgcagggccagggtcaagggcagagacccaggtcctgacagcactccctgaccatgcccccatttctccccagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgtgaggccctcccaatttatcccggccctatcctacactccatcccccccttctctgctgcatgcctggctacaatgtgagccccctcgcctcgcctactctgcctctctgtcccccagctccagctccagcaaacctgttctcagattgttccatttttctctgtgtccccttcaggcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccgggtgagtgtggtgagaaagattggcagtaggaagaaagccagcttgtagtacagagcgccatttactcaaggcttgctgttgtcaggcaaatccaggcccctatctctagatgactgactgcctgtcatcctcagaccccacagcagggccctcagcatcggaccagagtacttggtatctggatgaatcgacactcactgacaacatcaaaaagacactgcacaagttctgtggcccctcccctgtggtcttcaggtaaatcggatctctgcatacctgtgtctgtggtggagggggagcgtccctcaggctgatgacagatcctttcttctattcatgcctgtgacccctaccttttattccctgaactggcacagtgcctggcacacagttgtcactaacgaattgatggaagatgatgaccttgtacagtcacagagtggtctgctcttacctagcaagagttccttttcttcttttgatagatcaggaaatggaaacagagaaagattttttaaagagtttttgtggctgggggcggtggctcatacctataatcccagcattttgggaggctgacgtgggcagatcacctgagatcaggagttcgagaccagcctggccaacatggcgaatctccatctctactaaaaaaacaaaaattagccaggcgtggtggcgggcgcctgtaatctcagctacttgggaggctgaggcaggagaattgcttgaacccgggaggtggaggttgcagtgaggtgagatcgcgccattgcactcaagcctgggcgacagagcaagacttggtctcaaaaaaaaaaattttgttacagatgtctttttccctctatcttctgtattttggggccggaagcccttttaggtttcattcagccccgtcttactgtcatggttttctgttcctctgcttttacagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacaggtaatcactcagcgttggggagccccgtggtagctcattctttccctccccctgcctcatcctcctcttgctgaaatggactctgggagggctactctgcctttctctgagctctcaggtgcagctcacagccttctttgtctccagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggtgagtctcccctgaggctcaccacagaactgagcctgggccagctcaggacagactgagccttcatctccttgtttgcagagacataccatgattttagtcctcgggaaacgggaggtgctgagcactggtgttagcagtgatttacgagtcctttttctgagaggctttcatccttccttcccctaaataacacccacttttcaaaattctccagtgtttcagtgatgcttatggggctgggtcaagaagtactttcctgtatcctttccccatgcctctctttggggtgtacacctactccatgcccatcctttcccagtagcccctcagcagcctcctgccccttgttcccacaggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtgaggggatggaaggagggagggctgggtgctccttagccacaactgggaggggctatctagctctagttgggagtgtcaggaccatcagcaggattgtgagaaccctgttgcaggcgccgaactggtctccctgctttcagtctactcacttttctgcttccacgagattttcctgaaatgtgatggtgtcactctgctgcttaaaacccttcaatgggttcctgttgcccttatgataaaatgaaagtggttggcatgacctgtgagggtccacttgatctggtctttgcctgctttgccagcctcacttggctgctctgtcctttgcactccagtcagctgaatcactcatgtatctgccatgctctctctcttgcctccaggattttggacagattgacctttctgcctggaatgctcttccccattagcccgtgtttctccttcaggtctcagggatcttaaagatcacttcctctagggagtctctctgatactgtccctgtgccccaagatatcccacctgcttccccttgacctttccctgtaatagctggcatcacggtggcatgtgtgtttatgtgtctgtctttctaaccagagctcctatggagcggcacagggcctggcatgtagcaagtgttcaaggaatgttggctgcatgagtgagcatgatgtcctgctcctggaagttgggactttaacctgtctggtcccatgtcctccttccaggtactgtttgcctgtgctgaggccctgcatgcgcatggctatagcagtgaggcctcccgtctcactgtggagcttgcccaggatctgctagccaacccacccgacctcaaggtagagccgccccctgccaaggtgagagacccccttcctctaccttcccctcccccacttacccccaacctgctcccatgccccaccccaagtgagagcatccttctacctccaccaaggtaagtcagaatcatctgcctgtctcctgtgtttcttccctttctagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtcagaggctccatctcagccttgtatttcagtctctttagagccttgcaccttgatctctattgacacaccagaggtctgagctccttcctgtgccctcaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagtgcctgtaagacaggaattcagggcaaaaatgtgtgctatatggctgggcgtggtggcccatgcttgtaatcgcagcgctttgggaggctgaagcaggaggattgtttgagctcaggagttcatgaccagcctgggcaacctagcaagacctcatctctacttaaaaaaaaaaaaaaaaaaaaaaaaaaaattagccaggtgtggtggcacatgccttgtgctgccagctactccagaggctgaagtgggagaattgctttagcctggagattgaggctgcagtgaactgtgattgcaccactgccctctagcctgggcaacagagtgaaaccttgtctcaaacaaagaaaaaaaaaattgtgtgctatgggtattgggtattgtaagggcagcaaaacaaaaatctagagaaaggcctaagggaagtggtagaatatggaatgtgggttaaaagatcagtaggtcctaaaccagcgaacaccatgagtaaatacacaacgcaatcaagttttcatgagaatgaggaggccagcttccctaaaatgataagtacatgctgggtaagcagattggacctggttatgaaggttttgaaaagcacaccagagcttaggctggatataatagtcaacgaagacttctataggtgatgtgggttggaccaagggaaccccttacttcatatgctgatggcttgggaaccctggcctcttacctttgctgtcttgggaattatgactactctcaatccccataaggtcctctttctcgcaggcatgaagacaacagtgagcgaggcagaacatcccctcttatgtgaaggcacacgtcgggagaagggtgacctggcattagcactaatgatcacttacaaggacgaccaggccaagcttaagaaggtaagagactggggctgggtgcggtggctcatgcctgtaatcccagcagtttgggaggcagaggcgggcagatggcttgagcccaggagtttgagacaagcctgggcaacatggcgaaaccccgtctctaccaaaaaatacaaaaaattagcagctgggtgtggtggcacatgcctgtagtcccagctactcgggaggctgaggtgggaggattgcttgaacccagtaggcagaggttgcaatgagctgggttcacgccactgcactccagcctgggtgacagagcaagaccctgtttcaaaaaaaaaaaaaaaaaaaaaaggcaaggtactggggcctttgacaggcagagaaagagagcacattttactacctttctcagggagtttccagtacaatgagaaaagtgctattttaggctgggtgcagtggctcatgcctgtaatctcagcactttgggaagcagaggcgggaggatcgtttgagaccaacctggccaacatagtgagaccctgtctctacaaaaaattagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaagaagaagaagaaaaaaagaaaagtgctcttctgcccataggaggtaagtagggaatcttggggacatctcataaagaataagagaagaccaatggttcttataggagtgcttgggcatggggtggaagaagagaagcagagggcataaagtcattcattcacttatttcagtatttattgactatcagtatattctgccctgtggtgttaatggaggataccaagatatgttggggttaaataagttacaaaaagacatgtaaaccaggaggtcatcctgtggttgtaagtggggaaggctccctgaggatgtagcaattggctgtttcaaggagaaaggaaggtaatagaagtcaggagctaaagggcatcctgtcactgcttctctggaggtcactgcttctgtcttccagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctggtgaggtgggggcactgggcaggggggatgaatggtgtggacctatgttgaggtcccctttcctgggctcatcccagcgtcctgttttcctcacctagagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggtaggatagcctgtgggctagcatagagggaaggataatcctgaaggttggagtcttaacatctgggactcctgacttctgagactgacttctcttgggggttaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtcagtgggaagaactccccatcttccctgatctggcccaccctcagagccacacccctagtgcaatccaaccattgtctcccagcatcctcactttccctggtccttcccaacctacccggatgcccatttcaaagaaaccccaacccccgtccctaccccattgccccttcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggtaaatcatttgacctgacttgggtatgggagggggattaattggtggggataagacccttatctttgtggggttactgatctgataaaaagacattattctcacaccccagtggtgcccacactaacccaactctgcccttctctcctttcccctaaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggtatttctacgggcaatctgggaacctcttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacaggtgaatggaggggaggcacactgggcaggggaggtggggagggaatgttctttgtctctctttgggctctgagttcctcacatggctctcaccccacttagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggtgagaggacatccctttctgtgctcctacctgcagttgtgccagtggctcttcagaggacccttcctctagctcttcatttgtttactgtggggtcaggtgacaggttggggtaaagggtgaagaggatacaccgtaccatgtgcccacccttatctatctcccaggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggctctctgccaggccagagctgagatctgtaagttgggtccctagggcagaggtggccacccccgtctcatgcccctccccctgccccccaggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcaggtgacaacctagaattatggagcagggtggagcacttcctgggtggtcttggaccagagggaggcagggcctgtttctgtgctttgtactaaggctcatcctgcacacatcctcctccagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctagtcga

SEQ ID NO: 1941 - DNA, 207 bp, Homo sapiens
ccttgagtggtaactttatcttagtccaggtgattccagttgcagcagtagctaggtgccctgcgataactctctccccttgagggtttccagtgtgggaagttgtcatttaggcgcgccaaaagtggtctggcctctcgtgcttcttgagatcccttccgggctctggtctatcttgtctccttagctgggggcctacagtcatct

SEQ ID NO: 1942 - DNA, 2124 bp, Homo sapiens
aaacagaaaaataaggatgtttattaaggacatttctagcccacagctagggctcatactcggctctatgagccactgtccgacctcatccccattcaatgtgaatgacattagggaggccgggccacaggtagatcccactgcctggctaaaggggccatagcaaggggtccctcccatgcaaggggtctctcccatagccaggtatagaatagatacactgctgcggatgaagagggaaatctcattggactaatacattcccctacaccctgcctggaccctctcattcctccccacctcccaagatgatgggtcaaaggtacctagcactattatgtggggtaccaaaggaagcccctttatttgtcccagaactgtgggaaaaggatacccttcccttctcagccatctcaggcctgggggctactgaggtagagggggaggggccaggccactctaatcccccttgtgggccctgctctggacctgccccttagggaagcagggggcattttgctggtatgggaggctgggacatcagcccagactggaatgctgcagttcttcccgaagccacgagggcactggctgtccaagccggctcagcagcttcgacaactccaaattatggttccggaaaaaatccgtaaggaaaagacgggactgacaggagaaaatgaaggcagaaatggtaagaagtgggacacagaatcagatcctggaagtggagagggattcccctgcccctggctttacttacctcagtgtccatatctggatacctccggcctttgctccggcctagacagcgagtcttaccaccttcaagtccctggcaccaaaatcccttatcatcatcaaacctgctcaacaggaagaggccatgaggtggcagggaaaagagaaactcaagttccataaatgcacaatgcccttccctgcccacagggacatgtctctccttgtgagacagagtaaatctatgtctctaacagacatggtcaacctgcttccccatttcccatacagtactcctcccctgggtcatgctctcccacctgagggtccgtgtgtagttcagaaagggtgtgatacccaggaacttctggatgctctccattgaggctgctgggttggtacgcagctcttgcccatccacaatcagcaactaaaaggacagggatgtggttccctctatattcctaagaagcctctgggctgaagggaagaagaggggaaggggaaccccactgagggctcttgtggggattatacctgtccagaggggtagtaagtcagccagcgttgtagatgggtagaatagtagccagggacaagacagcggttctgcagggagcgtagtgccagaggggtctgggaggaggctgaaatcacctgatagaaggtatagttcagagcaactgggtctccatgggctcgctgatgctgaaggacaaagagaaggaaggtgaaggactggtgatttgacagtattctgcccttacgcttggtctggagacagacagcacagcacgggtacccgtccccaaggcactagttaagtttctcaaacctcactcctttctccctctctagcagtcactgtcccctcccccctccccccaacctttagcctgtgtgtccctagcttcaggcagacctggtaccaggagtaggccctgtcagcagggttggtgagcactgtgatgatcttggctcgtggcaggagggcagccccccgccgtggtacaacttcagagtcaaagtaggtggcacttttttcaaataggaaatcagtgctggcattggaaggaacagggaagaaatccatgtacctaggaagtagcacagaagagagagaagcagaaaaatatgcagagtgaagtggccagaagtctgtgctgagggaagctggaatggggtattttgggggaagggagtgttcctctgagaaacattcaaatggggcccagtctcaccagtcaatacccttgtggtaattagggctgttgaagaactgaatctcctcaaatgtgctggggctagggaagctgctagttacagctgggtgcaggctcaggaagaagtgaatagctgtagtccctaaatgggagagaaaga

SEQ ID NO: 1943 - DNA, 207 bp, Homo sapiens; identical to SEQ ID NO: 1941

SEQ ID NO: 1944 - DNA, 2971 bp, Homo sapiens
aaacagaaaaataaggatgtttattaaggacatttctagcccacagctagggctcatactcggctctatgagccactgtccgacctcatccccattcaatgtgaatgacattagggaggccgggccacaggtagatcccactgcctggctaaaggggccatagcaaggggtccctcccatgcaaggggtctctcccatagccaggtatagaatagatacactgctgcggatgaagagggaaatctcattggactaatacattcccctacaccctgcctggaccctctcattcctccccacctcccaagatgatgggtcaaaggtacctagcactattatgtggggtaccaaaggaagcccctttatttgtcccagaactgtgggaaaaggatacccttcccttctcagccatctcaggcctgggggctactgaggtagagggggaggggccaggccactctaatcccccttgtgggccctgctctggacctgccccttagggaagcagggggcattttgctggtatgggaggctgggacatcagcccagactggaatgctgcagttcttcccgaagccacgagggcactggctgtccaagccggctcagcagcttcgacaactccaaattatggttccggaaaaaatccgtaaggaaaagacgggactgacaggagaaaatgaaggcagaaatggtaagaagtgggacacagaatcagatcctggaagtggagagggattcccctgcccctggctttacttacctcagtgtccatatctggatacctccggcctttgctccggcctagacagcgagtcttaccaccttcaagtccctggcaccaaaatcccttatcatcatcaaacctgctcaacaggaagaggccatgaggtggcagggaaaagagaaactcaagttccataaatgcacaatgcccttccctgcccacagggacatgtctctccttgtgagacagagtaaatctatgtctctaacagacatggtcaacctgcttccccatttcccatacagtactcctcccctgggtcatgctctcccacctgagggtccgtgtgtagttcagaaagggtgtgatacccaggaacttctggatgctctccattgaggctgctgggttggtacgcagctcttgcccatccacaatcagcaactaaaaggacagggatgtggttccctctatattcctaagaagcctctgggctgaagggaagaagaggggaaggggaaccccactgagggctcttgtggggattatacctgtccagaggggtagtaagtcagccagcgttgtagatgggtagaatagtagccagggacaagacagcggttctgcagggagcgtagtgccagaggggtctgggaggaggctgaaatcacctgatagaaggtatagttcagagcaactgggtctccatgggctcgctgatgctgaaggacaaagagaaggaaggtgaaggactggtgatttgacagtattctgcccttacgcttggtctggagacagacagcacagcacgggtacccgtccccaaggcactagttaagtttctcaaacctcactcctttctccctctctagcagtcactgtcccctcccccctccccccaacctttagcctgtgtgtccctagcttcaggcagacctggtaccaggagtaggccctgtcagcagggttggtgagcactgtgatgatcttggctcgtggcaggagggcagccccccgccgtggtacaacttcagagtcaaagtaggtggcacttttttcaaataggaaatcagtgctggcattggaaggaacagggaagaaatccatgtacctaggaagtagcacagaagagagagaagcagaaaaatatgcagagtgaagtggccagaagtctgtgctgagggaagctggaatggggtattttgggggaagggagtgttcctctgagaaacattcaaatggggcccagtctcaccagtcaatacccttgtggtaattagggctgttgaagaactgaatctcctcaaatgtgctggggctagggaagctgctagttacagctgggtgcaggctcaggaagaagtgaatagctgtagtccctaaatgggagagaaagaccagcttcaggcagccattgtgggagggaagccagctcaacagcataagcttgaaggaagtgaaaaaataaccactctgggtaggaaaatcccctatggccaaactacaatgataggaggcaagtctgagagaggcccagggaagggctaaaacagtggttctctgctttaactgtgcaccagaatgacttgtgatcttgtaaaaacaccacagatgattctgatatacaaccagggttaggaatcactgcctcaagagactggatcaatgaggggtgggtataaaaggagttcctttttttctctcttaaaaattcaaattaaggccgggtgcggtggctcatgcctgtaatcccagcactttgggaggccaaggcaggcggatcacttgaggtcaagagttcgagaccagcctggccaacatggtgaaaccccgtctctactaaaaatacaaaaattagccaggtgtggtggcacctgcctgtaatcccagctactagggaagctgagcagaattgcctgaacctgggaggtggaggttgtagtgagctgagatcgtgccactgcgctccagcctgggcaaagaagtgagactcttatctcaaaaaaaaaaaaattattaaaattaaaaatacttttttcactcctgtgattacctggagagagaagagagttccttgacaaaaggatcctttgggtttaaggcagggcaagagaagttagctaaggatacttcacctgttttctggggtcccacaatgaggaacttcgggagacgatcacaggttttctccttggaccagatatctttgtgcctcttgtcatcacagggattctgaagccaggg

SEQ ID NO: 1945 - DNA, 1821 bp, Homo sapiens
cctcgagcctagtagttcaaggttgcagtgagctaggatcgggccactgcactccatcctgggtgacagagtgtgaccctgtctcaaaaacaaacaaaaaacacctttggagaaactgcagctctgtggacacccataatcccaagcagcatgcttggcagtgccctcctcccactgcttctgtctagaaactacacccacgtgggcactccccctacccctaaaaaaccaggccactccaaggaggaaattgtctcaaccagcatctcacagtgaggaaaaatctgcatcacaaattgcaggccaccatgaagtttctggagtaccactgccagcctcttccaggcttgggtaccccttcatcacctcctccagggagcttttcatgacttccccagaataagtcactatgcccatactgatgttcccagtcctgaacccactccttcagcactggcatccaggggctgtgaattttcacttccctgtctctctcatcagactccactcttctacgagaagggaagaatttgcatttattgtaaaatgctgattaggtgctaatcattcgacacccaccatctctaattctcaccacagttctgtgagccggatgttatcattcccactatacacactcaggtgaaatgacctgttcaaggtcaaatccaggtccatatggctcccaagcctgggcagcctctctatggtctgatggtgtctcgtcggctccataagccccactccctgcccacacccccagcacatcacttagaaaatgcccctgggttacagtgccacggtcagatgcacagatgtgtacacatggggtcacagtcactgacctggaaacaaagccactttgcccatgcacttatttctcagcgccagagaacccagggtgcaggaaggcctcggcacaccaccacctccactgccaaggcaacgagctggggccggcacgtggtgagcaagaaaggcaccaagctctggagctggacggaacaaggctcaaatcccagtggtaccaaccacacgctcccgggcaagtgatttccaatccctaagcctccccatttggtcatcataaagatcccccctgcctctggaggctgctacagtttgtgaaaaggagggtatacacaggctccgaataaacggaggctctcgtcccttctccgccttccctgtcactggctccagggtctgagagagcagcaaccttgtttctctggtctgtaaaatggtctgtttctttctggctccactgcgctatggaaatcgtggggttgcggggaggctgcagcttgtcatccagcccccaggcactgactgcagagatcccacccctgacccccccagactgggatgccaggaggggcagaggatctgcacttctgagctgtgtgccttgagccaagcacttgaccgcctgtgctccaggtcccctagctttgagcaggggctaacggaagaacctgccttgccaggttgttgtagtaaatgagtcaacacacgtttcacacttagcacagtgcccagctcccagtaaatgctcaatagatggaagctatgattagtcatggaacacggcctttctgctgtcctccctgccatggaaaatgggtaactcagctggagggcagttcctctgtgtagactggccaaggccccggggatgaggcagggtacctgggtgccaaaccagccccctctgctaccaatgctcggcaacacaccgacagtcaagacacacaggaggacgtcccatctcccttgtatccaattcggcaccatatcccagtgcctggcacaagacct

SEQ ID NO: 1946 - DNA, 1821 bp, Homo sapiens; identical to SEQ ID NO: 1945

SEQ ID NO: 1947 - DNA, 313 bp, Homo sapiens
tttctttttttttttttttttttttttttttgagacagcgtctcactctgttgcccaggctggagtgcagtggtacaatcacacaactcactgcacctccacctcctgggctcaagcaatccccctgcctcagcctctggagcagctgggactataggcatgagccaccatgcccagttaatttttaaaaattattttttgtagagacggggtttcaccatgctgtccagcaggtctcgaactcccgggctcaagcaattctcccaccttggcctcccaaagtattgagatgacaggtgtgagccaccgcgcc

SEQ ID NO: 1948 - DNA, 313 bp, Homo sapiens; identical to SEQ ID NO: 1947

SEQ ID NO: 1949 - DNA, 1399 bp, Homo sapiens
ccttgagctagcatttcattatgaccgtgatttttccccgcatcactttccagccttgtggtccacaattccactgggccctaagtatgtactgaactttcctgcctccctcattttgctctgcttgtgcaattttttccaccctccatctctgtcaaacataagccttcctgacctctaagacctacctttgtcatgtgcctttaccctcaggcaaggggcaatctcttctattcctcttctaccttcctgtagcttctcccccagggtttatcacattctgccttgaatcctagggaacaacatgtgtagtggaatgaacacaggcctctgaatccaagatgtgagtttaaatcccagctttggaggtggttacttaagttctcagtgccttcattcttcttcctatataaagtagatattacaatatctaacttacagagtcattgggagctatacatgcagtgattgggtaaagcacctggcacatggcaagcaattagcaaatgctggttacttctacttctttctcttctcttttcccagtgtatcataagttccttgagagcaggcaccatgtctgatttacccttgtatttcccacagtacttcccgtagtgagttacccttagtaaatactcagtaagttgaattgaatttaaattacctgtaagtcttaaaatgtgggattaaattaagagtatgttgccctggaaatacccaaatgtctaccgatggatgaatggataaacaaaatgtgatatacacataatggaatattattcagccttaaaaaggaatgaaattctgacatgtgctacagtatgatgaacctggaagacattatatgtgaaataagccagacagaaaaggacaaatactctatgattccacttatatgaagtacctagagtagtgaaattcatagaaatagaaagtacaggttgacatcgcaaatctgaaatgggaaattctccaaaatctgaaactttttgaatgctgacatgatgctcaaagaaaatgctcgttggagcgtttcagattttggatttttggatttgggatgctcaactggcataatgtgaatattccaaattctgaaaaaatctgaagtctaaaacacttctggtctcaagaattttggataaaggatactcaatgtgcaacatgtagaatggtggttacaaggtggtaggagagaatggagagttactgtttaatggtacaatgttcccatttgggaagatgaaaagttttggaggtgtgtgatggttatggttgtgcaacaatgggaaggtacttaatactgcttaactgtgcacacttaaaaatggtaaaaatgataaattttgtgtatgtcttacaacaataaaagaagttttttttttcaaaaaggaaa

SEQ ID NO: 1950 - DNA, 1399 bp, Homo sapiens; identical to SEQ ID NO: 1949

SEQ ID NO: 1951 - DNA, 788 bp, Homo sapiens
ggaaacattgcttctgtaccagccaaccttctgctcctgaagaatatctctgctatgggcctgtactgtggtcaatacaaaaaatgaactttcccgtcttctccaagagcctatcttcagtgcttcggtactgccagcaagggcgcatccaaccatatgtcggaatggttttcaagctggatgaggtcaatgatgccttccttcatgtgatacaggggaaatccgtgggcaaggtgcttctcgctcttaaataaatcctcacctgagcagcaaagttaacatgtccagatcaaaactccacatctttccccaaaacctgatttcccttctgtgtttccaaaggtgttaccactttccttaccaatccaggtttaaaatcttggagtcacctttgattctgtttactaattgcccctaattaatatgattatatagtttattgtccaaacctttttgagagtaaaagggtgccattagtaattacatcaggaaaacatatcccaggcaaaccaggatatatggtcagcctactcgatgcattatgaaatgcagtgattgccaagttctgtcattcccacctctaagatatctcttacctccatatcctcttttccattctgactaattaagcctcaactgctgtcaccagtgaccttctaactgcttttcctacctttaaactaccctcaccccctccattcttgtgatgcattattgccatggtgatcttcccgaagcatagctctgactatggcccatctcagaaaacctacagtggctcaccgttg

SEQ ID NO: 1952 - DNA, 788 bp, Homo sapiens; identical to SEQ ID NO: 1951

SEQ ID NO: 1953 - DNA, 1344 bp, Homo sapiens
tgattgtaagtttcctgaggcctcctcagaagccaagcagatcttagcaccatgcttcctgtaagccctgcagaaccatgatccaactaagcctcttttctttataaattatccagtcccaggcatttatttatagtaatgcaagaacgaactaacacagcatggaaggctcttgatgatctagtgtattactttcttgtggctcctgtaataaattatcacaaacttagtggcttaaaacaatacaaatttatttattctcctgcagatcaggcatcagaagtccaaaatcagtcttctggggcaaaaatccaggtgtcaacagggctgtgatacttctgaagactgcagggagaatccgttttccagcttttttcatccaccagaggccacctgtattccctatcccacaaccctagccccttcctctatctttgaagtggactatttcatcccctgtttctatcatgacagtgccttctctcatattgaccctcttgccttataagattccttgtgattacactgggtccacctgcataatcaaggctaatctctccatctggagatcttaatataatcacatctacaaagtccctttggccattgaagtaacatatttatatgttttcattattaggatgtgggacactttgtcagggacagggatttttcagcctaccttttttcttcaccttttgccaccactctcagcctgtggtctcaattgccagcctttacacttgctacccccattgtctgggtagttcataccagtccctcaagactagcctcaggcattgcctcttctgggaatacatcctcttacaggccaggatatgactcatgggtgcattcctaatagcacttcacttatttctactgtcaccacactgatctgtaattacttgatttgtctgactcttctgggggcttgtaagcattctggcacagagaactatgacttactggggcttacatctcttgctaaacacagtacctaaaatttagtaggcattccctcataaacatgaatgaatgaatcaaagaatgaataaacatttaggaaatgatgttgtgttggtcaacttctttcctcatcactgttaaagataaaagaatgccaagccaggttgttcagacagaagcaagcaccacatccctgagagagcagcacatctgggcagccatgtgtgagaagtcggttgcattccccatacacagttgtctttgcagctgtactcttaaccactgtaaccacagaagtggggaaacaatagggtggggtgaagtgaaaagaaaattttccaaaacttcatttatctaataaatacagatatttaa

SEQ ID NO: 1954 - DNA, 1344 bp, Homo sapiens; identical to SEQ ID NO: 1953

SEQ ID NO: 1955 - DNA, 340 bp, Homo sapiens
agaaaaggaagagctattctgacagagaaagatggcacaaagaaccacttggtcttagtctcagactcacctttgacctggttgtggtgtcccctaagtgtgtacagcagtcacaaaagtccatctgaccctgccctagtctggctgtcatatgacctatcccccacccccactgcgagtatctttctaaagaggaaatctgatcaagctacctccctaactaaaatcccttagtggctttccagcatggcacgtgacatagcttggattcttgtccccatccaaatctcatgataaaatgtaatccccagtattggaggtggaccctggtgagagcacc

SEQ ID NO: 1956 - DNA, 340 bp, Homo sapiens; identical to SEQ ID NO: 1955

SEQ ID NO: 1957 - DNA, 2406 bp, Homo sapiens
gtaaaagtggaggatatgagtcttgtggggacacagagttgaggcatgagctattagtcagagccgtaaggctgcctgcaggagaagaactttggatggagttttgaaggaagtgaggaaaagatctgaattaacgtattaacacataaagcttgtcatctgaacaggactataagcatctcgagggtaagaacgtgccttttctttcttacacattcccagaagacccacattcctcattgggctctctgtaacagtatttactaagcacttgaataactggacatgggcaccatgttgctaagttgattaaaggttggtcttccactctgccactggccacagcacaaagtgaaaacagatgtcacaagcaccttgtagatctgtcccttttttcttctgatgttcaccctccttttgagctctttctttctccaacattgcttacaaaataatctttatgcatctgagagggagcaaatattcagtaactttctgcagctgtcctcactaaagaggagaatctgttgaatgccactggaaatgtaaggatctcttgtgacagtaacatctcaaggggaaactagtggttaaattgttaattctttgagtctgaaacttttttcatttgcagtgcagataagtgcctgatcttgcagtatcacgtttctgacttctttgttctggcttcattttttttttcccaaaatgccattttcatttgttcttagagttcagaacatgtcaaagagcttctttaagcagtaggtggttttacagagcccacagagaaggaaaactaaatatcatcccggatgcagtccactacgatcgtggaggagtcagattactctccgggctttgctgtgtctgcttgtgaaacaggaaagggagaactgaggcaatgagtcacctcacttgggcccaaagcaccacctacgttgaatatggagaaaatgtgaagcaagagtttctttttatacataatcaccatttgtacataatcaccattttctccatggttcttatccaattcagtgcatcttaaaggatggtttgtggaatcatgacatagcagaaaaatccaggtactatcagtcttgcctgtttctacctaactctttcatttaaactctcactagaatctataggaactgttagcatcaattttaataagttgtcaactaagtgattagtggtatttattggttatttttgacaaaataatggaatcatcaaattttgaagttgagaagtaaagtaaaaatttgtgccaaaccccaaatgtagacaaggtcatattataaacattaatgctgtcccaaactgccaatgcattgcgtagaactgaggttagcaggttaccattgatttcctctacttatgctttaagaggttggcattggtaagccgctacactttcttggtcaatgaggcagaaacccctttgcaaaactctcaactgatgaaaagattagctagaatgactctaggaactgttttctaaggatctgactcattgattcctttttttggtagggttctctgggccaagttagttcgagtatttatcatttaaattaggaaattaccatcaccatcatcatgtacattcataaatcaaagcaagattagagaaggaatatggtggatcacagagcaactcagaaagacgacagcaacaactaggaaatgaaacaccatggttgtatttcaggaaccctacccagcagataggaattaccatagctcctaaaattccatctgggtggttgatggagcctcaattaatctgacaccatagcccatgctcccctcttgctacctgctgaagttagcagggaaaagtcaaagagggtgctgtcagtggggtcaattcttagggatcatagtgaaccaccctccattgcactgactctttcccacaaaatgggctagagatagcagctctccttatgtatttaagaaagaatggtcaaaaaatacaattcacattttattctggtatataccattttgacagtgtttcacaatgtaggtaatatgaatgggagtatttaaacacaatcctgtttaatattcttagccagtacttattaaatgcctaccaagcctggcattgttctagagacctcaaaatacacctttaaaaacatattttattgacagttgtataaatgaagaaaacaagtctcagaaaattaaagtgacttgcacagatacacaagctagaaagtaataaaactgaattttgaacccaggtttgtcagactctaaagtccatgattttctgctccatgtggccaacccagttagaaaggttataaaaaatcttaacagtttttcagcccttctcacacttagctttaggattaaaagtattggtcatgatttgcaaaaaaaaaa

SEQ ID NO: 1958 - DNA, 718 bp, Homo sapiens
cctctatattagagagaagatttacaaacgttggggaaaaaatggaaattgagactgactcctaaggaaacatctgttcactcactcagcaaacatttagcccactctgctaatgctaggcactgtgctagatatttggagagacactggagaaaacttaaggtccctagtcttgtggctcttacattctagagagggattataaatgacggcgtagttattaaaaaaatacagatgatgatttcaagccttataagagcaaagaagaaaagtgaaccaagttaatgtaatggagagtattggagtaggcgaggctgctttagatcagagagtctgggtggacttgatggaggaggtcatggatagccttgcagctggtagacctgtgggcaacattaacagcagataggacaagagggttaggggctaactgagcattcacctttgtcttctttttcccctcggttatgagtgtgacaaggcggaacatccaagggatatgttgcaggtgtcttaagagtcaggtaaaaggcaagatgattcattatatctgttctttttgtgatacccatgtaactacctataagcttcaaagtgaaataaacattacctcttgtaccttagcccgcttctcattcttcattacaaatttaagaaggcagttattaatgtgaatagtcattcttcttttcagcagtgccaactttaaaaaaaaaaa

SEQ ID NO: 1959 - DNA, 351 bp, Homo sapiens
gtaaaaaacaatatgtgaagcctttattccaactaggtaaaataaggaaggctttacaaaggagatgaatgacacttcagctgagccctaaagaatgaataggattctaatagaacagctgggggcaggcgtggtggctcacacctgtaatcccagcactttgggaggccgaggcaggcagatcaccttaggtcaggagttcgagaccagcctggccaccatgcaaaagcccgtctctactaaaaatacaaaaattagccaggcgtggtggcacatgcctgtaatcccagctacttggaggctgaggcaggagaatcacttgaacccacgaggttgaggtttcagtgagcc

SEQ ID NO: 1960 - DNA, 1365 bp, Homo sapiens
cagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagctttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgccagcatcaagaggggccatcttttgataggatgacacatgcatgttcaaacatattttaaaagattagggagaaaagaatactgtgaacaaatagaaaccaattatgagcaaattcacgaattcggttatgtactattgtggctggcaaaagccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttttgctaaatgaatgcatgattatcttatacaataaaagtataacacaaaatactgttttaagatagtcgctgggactctccttacccttgaagtgtccccctttccctcctccacatccagtcaaccgcaggttcctcccaggtttactatctgacatgttttagctctcttccttcttttccattcctctacaacttctctagttctggctttcattgtttctcaaccaaaacagtctccccttctctctcctccattcttgcgtccttccaaaacatcctctccaccctgccagagcagctcaccttagtcacagtctgactgcaactgcatgtgcttatcaatcctctcatttctcctcatcacctataacagtgcttttgacgctgcaacttgtgagccatttcgcgggttagaaaataagtttcatgggttgtaaccagtagtttaaaaaaaaaaaaaa

SEQ ID NO: 1961 - DNA, 13712 bp, Homo sapiens
  misc_feature (28)..(28): n equals a,t,g, or c
aaaggtcagcaactgtaatctgtatcgncttggaaaaaagaagggactacccagccgcatggtggtgtcaatatttgatccccctgtgaattggcttcctcctggttatgtagtaaatcaagacaaaagcaacacagataaatgggaaaaagatgaaatggtaagtttgtgtgtgtgtgtgtgtgtgtgtgtgtgtgtgtgtgtgtgtaactggagggatttacttttcggtgagccaaataatttgttttattaattttttgtttcattttcttggtatgtttataatagagtagatatttgatatatttaattaattcctttaattacactgtcttttcactgaattcagaaatagtattataattttgatggaggcaaatttctatttttattatttcttttccaaaggcataagagtatgtgatgttttgactttgagttttgctcttctttaaaaaaatttcactttgctgttattacaatttatcctagatccttagctctgttcagtgaaatgacttttcagtgacctgtgatctccagtctgtctgtgaaataattaatttcagtaaaatcttgcttttgtagctcagggttttcccagtcaggactcctgtgaacttaaaaaaaaaaaatcatccataaagattgttattttctggaaataatttaaatcttgccagtgacttaagaagactccaaatatcagcaacagccacttcattttgtcttgtcttgaaggccaccagagggcacttgggagggcctccaaactgcaggaaccagcgcagtggtggttgactgggagagttctagtgcctcttccgaagttaaaggcaatgcttcagacagtttcatttcttggagatttattttgcattaaaaataaattggctcattgttacttcatttttacctcaggccaacaatgataataccgtttttttctttcaaaggttatatttttaaatatccattttctccatgtcttctttgtgatgcatgtatcctatatatctgcctttaagtatttccaggtagcatgttcagtgacactatttggatttttacctatttattgaggatgtttttaactcatgtagtatttgtcttattacagaattagaacttatttggaaaagcattaagggaatattttaatgcaagttaggtccgaacaattatttgttattaatttagaaatatgtagaaccttagaggaaaatgtatagattttcaactttagaaatggtatggtatttctatgaataacattccagtaacagtcatcctcctttgttaataccgtttcataatgtttttggctctttttaaaaacttgtagcatgaaggtgacattggcatgtcattgattttttttttaagatacaacacaaagttcaatttatttttcttaatgtttctgatggcactttggttattggaattcattagaaatactgttcagatttttatttagtaagttacttttattgaaatataggcccttgcattatattgaaaagatacactgtggttttggctggttgcattgccattctccctaccttgctctggcccttcagcaaatgggcttaagtggaaacctttgcatgctaaaacgcctcttaatagacgagagtatcaaagttgacttgaatgatatagaaaaggatttcatgtggctgttttttcttaaaaggcttgaagtgctcttgaaaaacattttatgagacagaaccccactcttttgtagatgaagcatctgaaacccagaggcactaaaaggctttgcccaggatcacacagtttgtgataaaagtcagccctttgtgatttttgtgctctgccacttttggcttatggtggcacctttctaaagatacagaaggtttttttcaataaaaaaaaaatattgtctgattttttaaaaatcgcagtttggccctctttttcttaaggaccaatcaaaaacatcttcatgttgccttggaaagtctaagattgttagcaggaaatgttccttgaggtctgccgctacagttgcttttggtgttccttattcttgaaaaggtgtttctttcttaattaaaaaaatgaaaagataaatagttagagatatggcttggcttactgctatttcttttcagacaaatgtagtgtttatatcttgagtctagtttaaaatatttgtagtatttaaaaaatgcttgaaggttgcaacttttttttgtcagaacactggaaagttgttacaatcaacattgatgcacacccttcgtcttcccccttcacaagttttttggttttttaaaaacttgcataacagaaatttggcatctttctaggattgcaaagaagttacatcattactgaaatctagcccattattaaggttgtcactcacaaataagcttttgccaaagaaattggaattagcaaagatcttttgacagaaattggattgttgtgtttcatgttagtctaaattttcttccatttttgtcagttatgctataatctgttcccctgattaccgtagttcagagtggagggaaaaaacgtaacttctcaaattcatagcttagtgcagtgatcacttttattttttaaggaaagcagtgtagtttttttgtggcaagtatactttgaagtggaaatagggacaaaaagctttattataaaatcctattgtacattttaaaaaatgattttatctgtttttatattatattcttaattgcaaaggtaatgcttttctacatctggaatttcgttttattagtttgaaaatctttttgaaaatcaaattaccacattttcaaattttgtcagcaaaattgaagatctgtgtgatcagcatatgagtgctttcattgtgtgtcctaccagagttagacgacttagttgaagttttgcattgtggacattaattttaactttatatccatgttcaaagtccttaacttaaagcttcatactggataaaggtcattttataacttagaaaacgaacattcaaagaacatgttttactttgtttatatgattaaataacttattttatgttaattgaaaacaaatggccatgattttaaagttgccttttagtatttgtggttgtcatttgaaattatccataacccttgcttttattgagtttcaaacccttttaaaaacagcagctatgtttcccctccttccccattccccctcgtttcagacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaaggaatagaaagaattcttttccttgttatttggggagcacgtattgctttataactttggttgttgggagtatggctatcatataccctcatcagtgtcattttatatctgcctaattagagaaattttaaccttagtattttgatgtgttttccccattttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaaggttgcgtggcccttgctgtgactctgctgtcatcttctacttctcactgtgctctgtatttgcccctcttttaatagactgtcaacccattagattagaagggagaacaagcccctcacacccaaatcagcttcaggctgtgaaacacagctgaagtttacatttcaatttctgtatcagaaaaataagtgcctgaattcagaacaccaaagcaaagtataaagtttgtagtttatataataaaagcagcgtaggttaaggtgatcagcaaaatgtaaaaaccaaaaagtgaaaaactatctgactctggactggaaagactgatgaaactaaagcctaattttcgttatggaggaaaaatgatacgtggctttcgactacattctgctggaagttccgagacctgggttctcgcctagcagtccctgcttcttaattccttgcttattctgggacaagtcaccatcggtccctgcctcagtttcctcagctggatatattattttaatcactgtgagaaaatagaggtgttgatttaacattgatcattttcacattttgacaaccagtttacctgcctttgctccctttcacaactcttctttctcaatctcttggtttgtggtaaattcatttctataatagctcaagttaagaagagggtcttcttttcctgtcatcctgtgtaacaaaaatagcccaggaatagtgaggaatggtatcacttatgcacagattccagagtgtgaatgagactttagcgatggcagcacagtgtagccacatggagaggtgtgtgcggccctggtttcacttaagtgatgatgtgtgagggagactcgagaggaaggccccagcacctgcccagacagcacagtgccagagaaaagcattcagtgatcatgatagcacctgtgaggttttgtttttccttcttaacaagcgttagtcttttgaccacttgaagattttatgaccccagtttatataagaaatgtacttaatttgtcattaaaatttagtttccagaggctttttagtatgatatgtcagatatcctttttgaagaatatatgtatgaaaatgattgtaaatacaaatcttcttcggatttggggatcagttgctatgtggggatagtgtaaatgcttctgcacaagcttacggttccacttcggatcccctcagattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgaggttagtgctgttcaaaacgatgttgaaaaaagtggtctaactaggagtctctgtagtttcagagttctgacggcatagtggtctaaagggacagcaggaggtcaggggtgtgggacccagtgtgctgtgttctgtgggagcacgagtgaactgcagtttgcaggtaggcctcttgaacttgtctgcccccactgtgggctgtgtggtcattcaggtgaagagaaggaaccaggcctttcagttaggtacccttcccacgccttcatgagggcttccagcattgaggcatgccaaagaagtggcctccactgccggaccccaaggcaggtttagctttagtaaaagcccagtgtagcttatccttccttttttaaatggatcagaaatatttgctaatatctcagggaagcatcataaatatacattctgcttctacttgaagtgggaaaatctaatttaaaaaacaaacttctaaatttttgaccattggaatttgggaggcttctattgtaagttcagccaaaggctgtctggtgacagagctaattctaatgtgtttgtgagctatttcgaatttttgtaggaaaggatattgcttagatctttccagtctcttaacattcatctgcatacctgtgtcccccagagagactctcatttcctcctcttcccatttcatttcctttgattttcttatttttgtagattttcttataaggagtcaggaaatacaaccttaatactagtagctgttttagttgtcattgctttaatttgtaccttcccctttttaattgcaccaaacctttgttggggagtagtgactttctatgacaaaaattaagagtaggtttgaagtctagccgcagagccgagttcacgccctgccagctgcccagatgtgcactggaggagtcagtaggccctgctcttactttaacgcgcctctgtgctcttgtccaagatgaacagcctgagctggagcgtggcaggctgtgaggcgagaaggcgggaccagctcgtagacttccaagtgttacctagtctcattctttagaaatagctaagcttgaaatttgaggaattagttaaaattagatttaagctctctttggatgccagtggggcatattggttttgttagtttttgttcattcttttccttccctttgtttatataaacatatgtatagaagttacaagaactgattggaaatgtcatggtctggcatttctaacttactatttgatcttaagaaagtctctttacctctctgggcctccgtttcctcagctgtaaaaagagagaattaaacttggtaagttttaaaattcctttctatctcaaaaccataaatatgaacaataagtctgtttttttaagtaatcagcagtataaatgtattatatgtaactttgtatggctaaacaacctattagaaattagtattttcccactttctctttatttttttcacaaatgatttgtgttgattttagaaaagttagtacaagtaaataagaagaaaattagttaaatttgcctgattatgctacctcggaaataaccaatattaacattttgggaggaattgtggatgtgtatagatataaacatatctaaaatgtaaaatggaattctgttatgtataggatactgtcacctgttcttttcacgtataatatattgtggctgactttccgtgtattgatgggtatcgtgatgctcaggggccacacgctagtcaacacgtggctgattgatttaaacgcttctttatggccgagtaattaagtagtttttggttaggatgtttaataaccatggaggtgataaatacgcttatgtatctagttacctccttaaaataagttcttagagatgcaattgctgcatcaaagaattgtgaacttttcaaaggcttttgatgcatgattttcttttattaatttgcatacatgctatgtcagatactcggttatagtgaacacatatctagtggcttaatgaagagggaacttggaggaaaaaatctttcaaatataatttccctatttccctacaacagcgatttctgctccccaaagcagcatacacccgtgccagcaccagaccaattagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttagaaagaaaaaaacccacaaaattaaaaacaacttcagagatattattcatattattctttcattttgattgcagaaaagttttctgcaaatgtaccccgttcccctgtgcgagaattgcttgaaatggaaccagaaactgccaaatttaggtaagcaaaaaatgtacatggaaaaaacattaacttaaaaacatcaaaggggaaaagttcacaaagatattgtaaactaatgattctgaaaaatatttacactgtggtgtgctgttgtcagatttctgtttgtaatctgattgacttctcttttttccttctgtttttatgaaataatgctgtaataaagactagacggcagccctgtctgtcgggggtatgcaatggcagtaagtcgtaacgcgtgtttcctttgtgtggtgtcagcttatacatgggactcctggcctgagagtgcacactaaatgctgattgacaatgataataaatacttctgacttctaattcaagctgtttggattttttacagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggccccaaaaaaaaacttctttaggcatatgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 1962 - DNA, 19521 bp, Homo sapiens
cagaaggggaaagcgcttcctttaagcagtgctgagaagaggaaagccaaatgggaaagtctgcagaataaacaggtaatgagttaattgtactagcataacttagtatttgtttgagtattaaagattattaaagataagtttgaattttatcttaccaagttaaatgcatgattcgttaattttttagaagttacctaatcctcaaattttgttttgttttgttttaattagtattatgtgttgaatgttatttgaatgttctttttggtaagtattgagagttttgtttttatacttggcccattaatatatcacaaaatcattctcataaatcctttgataaatcccatttggccttagaggattatttttacaaatattttttaaaattaagttttactagcatttatgattttctttatccattagtgaaattggtctttttttttttcttttgtgtgtgcgctttgtatttatctgtccatttttccccttacttgaagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttaggtatgcctgtgcagtcagccagaaagaacacagatcatgagatcctgtttgcaaaagaacagaattaagttaaaattgtatataaaataattcttaaaagagtaaaaagaaaataatggatatcttatgtcttgtcaagtctcagagggagatgagaatctgaggtcagaaataaccattactgcttaagccataacagttggagtgagaatgaaattgttctttgttactgcatcagcattttcagtctgttttttcttttaaaaatccaaatatatgttaaaaagcaatagccttagcatgttctttgtcttcattattttcttcccattagtaaaatctctgcattctaaagaaactgttggcttaaacactcacattagttctggttatccaattggcaatatcaagactgttctagggattgaaggaattttaaaatataataggaataaccacaatatttattggttagttgctatagtgccaaacactagcttaaatgctgtaccctgtgttagttagctcatttaatcattaagacagtgctatgagataggaattgttagcccttttctcaggtgcagaagctgaggcacagagagtttatgtaagttgcccagagttactcagcgggttaaccagagtgcctgggattccaacccgtgaagctaggccccaggtcctgcaggatgcctgcaagcttcgtgaccttcttaactaccacacctagagtctagggccagggattaaagcagtagataaaaccatgtcccactttataatttacactgtaaattaaaaatttggaaacttgcttctattctaaagtttaggagtacatttttgggatctttgtttttgtttttaaattcaaattgctgttgctctcagcctagctgttttgaagaatctgatgtaaagttataaaaatgtctttgcagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtaagagatgatttttttattttgagcagttaattattcagtgtgcctgaaagtggtttgcagtgttggataatctcagaggatgagaacgtatcatgctcagaaattgctacaccggccaagcacagctgctcccttgttctaccagggccagcgaaagcctgtggcagaactacctggcagttgatgagtattgctttacaccaatcccacactcaggttttggggcttagctgatctccacgtgccttactttttgattgaaagtcagttcaaaggaagctatgcaagtgtgtacaccccttgatcctgagggggatatgaagaaatgtgcattgtagtcagtcaaggagcttctgctttgttgagttaaacatttatttgagagggtacgtcttggcttacaaggcatacagacatgagtaagacacaagtcttgtggaggagctcatctccaaagttttggagagtggagcggagaagagtaacaagcttcacagagcttggctgctctccagtgtgaagagggtgacaccagagttctgagtaattaacgctcgatagctcagagaaagggcgggctcttaaactcagcatggactaagacttaagaaaaggaatgaaggtaagatattcaagttatgggggaaaaatggaaaaaagtctcacaaggcaacatgagcctcctggacaaataccttagaaagctgctgatcacttgcagcactcagaaggaaggagcatcactgttgaatcaaggatggcattaatggaggaggcaagttgacagtgcataagcaaagtgaacagatggcagagcatgtcagcgtcagggaagcagccgtggcagcagtcagaagtgtggaaatacctgagaaaaggcttgaaaaggcagctggggtgaagctgtatcgtggaaggccttgaatgctgggctaaggagtttgcacgtgttttgaatgttgtaggcactgttgaaggaatttagagcaaggaactattaatgttaataaagtggtagtttaaaatgattaatctggtagcagaatgtagtgtgagttgaaaagcatatccaaaccaacagcagaagcagagaatgggatagaactagagttctggtagagaggaaggggctgaggtgagtgagaatttcagaagaaataattttagctaacaatttaaaagtgcttactctgcactactctaaaagataaccgtatacgcacacacacgtacacacacccacatatatacacatatatgcatataaacctaatttaatttttataattctgagaggtagaaacttttattttccccattttataggtgagaataggctggagaagttagcttgcccaaggtcacttggcaagtaagtggcagagcttgggtcgaatccagacagcctggctttggagaccttccccttccccatcacactaactgctccggatagaaccatcacaccaggcagcacaccaagcatttcccaagtgctcactcattcactcttctctaagcctctgggaaagagacaacacatccctgttttgcagatgaggggactcacacttagagagtcgaatgggctcctgtcaggtcacctaactgttcatctgggagagtcaggagtgtgtccaaggcctcccaggatgatcttgaggtggactggaggcgcagtcataacaaccacgtaaactggcaacttgggggcagtggcagtagcagggaggtagggagaaatgtgggaagtccatgttagagttgagattttagacctcatggaatatgaagtggaaatgttcagataattgaggctgtaggattcagatacggttttgtagagtagtcgccatacggaagctctgagaatggatgagatttccaagaggtggttgcaggaagaaagtatcagaggcttggacaagtgtggcataggcaataggataggatactctgttagacaagacagaggtgactttctattacaaaactcgtccatttgtctgctcagaaaccttctactccttatttctgcagaaagaatgatcactccctcagcctgctgttcaggccctttcagccctgatgcgttttggatcctaagcaggtggaagccccttgcagctcattggacagactccacgctcagacccccagccttggggcccttgctctgtccttccttctgcagagggcttgcctccatctctacctgtccagaattttgccccatatttgagaccttacgtagctctttcttcatcctgcccaccatttctgtcaacttggaatgtgatttccctcccatgagtccacgttgtactttatcctcttcttggcgcttgtgatgctttgttctcttagcttggaaagggaagctagcatttatttcagcctgctacgtttcaggcagagagggagagtacttttggctatagtggtcacacgtaccctccttttccctgctagcctgtgtgtcacgaggactgcccctctgtcctgctgccatcgttccctcagggttgcccaatcgagtgcctctcatatggggggtgtctattaaacaatagttgagttacatgggaagagggctaatgaagtacttaataataaggaaccgagctttatgaaaatgaaaatgggattgacaattctagaccctagtttccaagtactaacttgacagaaatgcaatgatgtgagaaattaagaaggagatagaggcattaggaaaaacagaccggagtagagggtaagatagtaaagctgttccattaatgtgaataaacagaaaccttttggttcattttttttaagttgaataaaagtgtcttgaaatggctgtaaaacaaaggaataatatttgagagagcattacagttgaaatcccgtttgtggcttcgattctaggaatataacattgtttcagttttgttcggtgccagttttcactttgcagctagagctgatggcatcctccccccatttcattgaaaatattgtgacatcttgactttttctatgggttcttttctactttggtaattccagttagcagtttgcattttatatcatcaggttgtattttcaaggctttgatattgtctgaagtgtttcttctcagtcattcataaggagtatgcatagttatatacattattttttctgctctgcatcttatattcagaaatatttacaccaaaaaagcatagaatatgtgggaatttaatattctttttataacatgaatgggtagaaaaactgtagagcccttataattaattgatgacatataattaattgattaattttaagaacatttaactgaggatatgttaatatgccttgaatgaattccagcagtgatcatttatggataagtatcctaatattttctgctaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatggtaagtttttgtgtgtgtgtgtgtgtgtgtgtgtgtgtgtgtgtaactggagggatttacttttcggtgagccaaataatttgttttattaattttttgtttcattttcttggtatgtttataatagagtagatatttgatatatttaattaattcctttaattacactgtcttttcactgaattcagaaatagtattataattttgatggaggcaaatttctatttttattatttcttttccaaaggcataagagtatgtgatgttttgactttgagttttgctcttctttaaaaaaatttcactttgctgttattacaatttatcctagatccttagctctgttcagtgaaatgacttttcagtgacctgtgatctccagtctgtctgtgaaataattaatttcagtaaaatcttgcttttgtagctcagggttttcccagtcaggactcctgtgaacttaaaaaaaaaaaatcatccataaagattgttattttctggaaataatttaaatcttgccagtgacttaagaagactccaaatatcagcaacagccgcttcattttgtcttgtcttgaaggccaccagagggcacttgggagggcctccaaactgcaggaaccagcgcagtggtggttgactgggagagttctagtgcctcttccgaagttaaaggcaatgcttcagacagtttcatttcttggagatttattttgcattaaaaataaattggctcattgttacttcatttttacctcaggccaacaatgataataccgtttttttctttcaaaggttatatttttaaatatccattttctccatgtcttctttgtgatgcatgtatcctatatatctgcctttaagtatttccaggtagcatgttcagtgacactatttggatttttacctatttattgaggatgtttttaactcatgtagtatttgtcttattacagaattagaacttatttggaaaagcattaagggaatattttaatgcaagttaggtccgaacaattatttgttattaatttagaaatatgtagaaccttagaggaaaatgtatagattttcaactttagaaatggtatggtatttctatgaataacattccagtaacagtcatcctcctttgttaataccgtttcataatgtttttggctctttttaaaaacttgtagcatgaaggtgacattggcatgtcattgattttttttttaagatacaacacaaagttcaatttatttttcttaatgtttctgatggcactttggttattggaattcattagaaatactgttcagatttttatttagtaagttacttttattgaaatataggcccttgcattatattgaaaagatacactgtggttttggctggttgcattgccattctccctaccttgctctggcccttcagcaaatgggcttaagtggaaacctttgcatgctaaaacgcctcttaatagacgagagtatcaaagttgacttgaatgatatagaaaaggatttcatgtggctgttttttcttaaaaggcttgaagtgctcttgaaaaacattttatgagacagaaccccactcttttgtagatgaagcatctgaaacccagaggcactaaaaggctttgcccaggatcacacagtttgtgataaaagtcagccctttgtgatttttgtgctctgccacttttggcttatggtggcacctttctaaagatacagaaggtttttttcaataaaaaaaaaatattgtctgattttttaaaaatcgcagtttggccctctttttcttaaggaccaatcaaaaacatcttcatgttgccttggaaagtctaagattgttagcaggaaatgttccttgaggtctgccgctacagttgcttttggtgttccttattcttgaaaaggtgtttctttcttaattaaaaaaatgaaaagataaatagttagagatatggcttggcttactgctatttcttttcagacaaatgtagtgtttatatcttgagtctagtttaaaatatttgtagtatttaaaaaatgcttgaaggttgcaacttttttttgtcagaacactggaaagttgttacaatcaacattgatgcacacccttcgtcttcccccttcacaagttttttggttttttaaaaacttgcataacagaaatttggcatctttctaggattgcaaagaagttacatcattactgaaatctagcccattattaaggttgtcactcacaaataagcttttgccaaagaaattggaattagcaaagatcttttgacagaaattggattgttgtgtttcatgttagtctaaattttcttccatttttgtcagttatgctataatctgttcccctgattaccgtagttcagagtggagggaaaaagcgtaacttctcaaattcatagcttagtgcagtgatcacttttattttttaaggaaagcagtgtagtttttttgtggcaagtatactttgaagtggaaatagggacaaaaagctttattataaaatcctattgtacattttaaaaaatgattttatctgtttttatattatattcttaattgcaaaggtaatgcttttctacatctggaatttcgttttattagtttgaaaatctttttgaaaatcaaattaccacattttcaaattttgtcagcaaaattgaagatctgtgtgatcagcatatgagtgctttcattgtgtgtcctaccagagttagacgacttagttgaagttttgcattgtggacattaattttaactttatatccatgttcaaagtccttaacttaaagcttcatactggataaaggtcattttataacttagaaaacgaacattcaaagaacatgttttactttgtttatatgattaaataacttattttatgttaattgaaaacaaatggccatgattttaaagttgccttttagtatttgtggttgtcatttgaaattatccataacccttgcttttattgagtttcaaacccttttaaaaacagcagctatgtttcccctccttccccattccccctcgtttcagacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaaggaatagaaagaattcttttccttgttatttggggagcacgtattgctttataactttggttgttgggagtatggctatcatataccctcatcagtgtcattttatatctgcctaattagagaaattttaaccttagtattttgatgtgttttccccattttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaaggttgcgtggcccttgctgtgactctgctgtcatcttctacttctcactgtgctctgtatttgcccctcttttaatagactgtcaacccattagattagaagggagaacaagcccctcacacccaaatcagcttcaggctgtgaaacacagctgaagtttacatttcaatttctgtatcagaaaaataagtgcctgaattcagaacaccaaagcaaagtataaagtttgtagtttatataataaaagcagcgtaggttaaggtgatcagcaaaatgtaaaaaccaaaaagtgaaaaactatctgactctggactggaaagactgatgaaactaaagcctaattttcgttatggaggaaaaatgatacgtggctttcgactacattctgctggaagttccgagacctgggttctcgcctagcagtccctgcttctaaattccttgcttattctgggacaagtcaccatcggtccctgcctcagtttcctcagctggatatattattttaatcactgtgagaaaatagaggtgttgatttaacattgatcattttcacattttgacaaccagtttacctgcctttgctccctttcacaactcttctttctcaatctcttggtttgtggtaaattcatttctataatagctcaagttaagaagagggtcttcttttcctgtcatcctgtgtaacaaaaatagcccaggaatagtgaggaatggtatcacttatgcacagattccagagtgtgaatgagactttagcgatggcagcacagtgtagccacatggagaggtgtgtgcggccctggtttcacttaagtgatgatgtgtgagggagactcgagaggaaggccccagcacctgcccagacagcacagtgccagagaaaagcattcagtgatcatgatagcacctgtgaggttttgtttttccttcttaacaagcgttagtcttttgaccacttgaagattttatgaccccagtttatataagagatgtacttaatttgtcattaaaatttagtttccagaggctttttagtatgatatgtcagatatcctttttgaagaatatatgtatgaaaatgattgtaaatacaaatcttcttcggatttggggatcagttgctatgtggggatagtgtaaatgcttctgcacaagcttacggttccacttcggatcccctcagattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgaggttagtgctgttcaaaacgatgttgaaaaaagtggtctaactaggagtctctgtagtttcagagttctgacggcatagtggtctaaagggacagcaggaggtcaggggtgtgggacccagtgtgctgtgttctgtgggagcacgagtgaactgcagtttgcaggtaggcctcttgaacttgtctgcccccactgtgggctgtgtggtcattcaggtgaagagaaggaaccaggcctttcagttaggtacccttcccacgccttcatgagggcttccagcattgaggcatgccaaagaagtggcctccactgccggaccccaaggcaggtttagctttagtaaaagcccagtgtagcttatccttccttttttaaatggatcagaaatatttgctaatatctcagggaagcatcataaatatacattctgcttctacttgaagtgggaaaatctaatttaaaaaacaaacttctaaatttttgaccattggaatttgggaggcttctattgtaagttcagccaaaggctgtctggtgacagagctaattctaatgtgtttgtgagctatttcgaatttttgtaggaaaggatattgcttagatctttccagtctcttaacattcatctgcatacctgtgtcccccagagagactctcatttcctcctcttcccatttcatttcctttgattttcttatttttgtagattttcttataaggagtcaggaaatacaaccttaatactagtagctgttttagttgtcattgctttaatttgtaccttcccctttttaattgcaccaaacctttgttggggagtagtgactttctatgacaaaaattaagagtaggtttgaagtctagccgcagagccgagttcacgccctgccagctgcccagatgtgcactggaggagtcagtaggccctgctcttactttaacgcgcctctgtgctcttgtccaagatgaacagcctgagctggagcgtggcaggctgtgaggcgagaaggcgggaccagctcgtagacttccaagtgttacctagtctcattctttagaaatagctaagcttgaaatttgaggaattagttaaaattagatttaagctctctttggatgccagtggggcatattggttttgttagtttttgttcattcttttccttccctttgtttatataaacatatgtatagaagttacaagaactgattggaaatgtcatggtctggcatttctaacttactatttgatcttaagaaagtctctttacctctctgggcctccgtttcctcagctgtaaaaagagagaattaaacttggtaagttttaaaattcctttctatctcaaaaccataaatatgaacaataagtctgtttttttaagtaatcagcagtataaatgtattatatgtaactttgtatggctaaacaacctattagaaattagtattttcccactttctctttatttttttcacaaatgatttgtgttgattttagaaaagttagtacaagtaaataagaagaaaattagttaaatttgcctgattatgctacctcggaaataaccaatattaacattttgggaggaattgtggatgtgtatagatataaacatatctaaaatgtaaaatggaattctattatgtataggatactgtcacctgttcttttcacgtataatatattgtggctgactttccgtgtattgatgggtatcgtgatgctcaggggccacacgctagtcaacacgtggctgattgatttaaacgcttctttatggccgagtaattaagtagtttttggttaggatgtttaataaccatggaggtgataaatacgcttatgtatctagttacctccttaaaataagttcttagagatgcaattgctgcatcaaagaattgtgaacttttcaaaggcttttgatgcatgattttcttttattaatttgcatacatgctatgtcagatactcggttatagtgaacacatatctagtggcttaatgaagagggaacttggaggaaaaaatctttcaaatataatttccctatttccctacaacagcgatttctgctccccaaagcagcatacacccgtgccagcaccagaccaattagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttagaaagaaaaaaacccacaaaattaaaaacaacttcagagatattattcatattattctttcattttgattgcagaaaagttttctgcaaatgtaccccgttcccctgtgcgagaattgcttgaaatggaaccagaaactgccaaatttaggtaagcaaaaaatgtacatggaaaaaacattaacttaaaaacatcaaaggggaaaagttcacaaagatattgtaaactaatgattctgaaaaatatttacactgtggtgtgctgttgtcagatttctgtttgtaatctgattgacttctcttttttccttctgtttttatgaaataatgctgtaataaagactagacggcagccctgtctgtcgggggtatgcaattgcagtaagtcgtaacgcgtgtttcctttgtgtggtgtcagcttatacatgggactcctggcctgagagtgcacactaaatgctgattgacaatgataataaatacttctgacttctaattcaagctgtttggattttttacagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcgcgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 1963 - DNA, 126 bp, Homo sapiens
agggattcaccagcctcagcctcccgagtagctgggactacaggcgcccgccaccacgccaggctaattttttgtatttttagtagagaaggggtttcaccatgttacccaggatggtcttgatct

SEQ ID NO: 1964 - DNA, 126 bp, Homo sapiens; identical to SEQ ID NO: 1963

SEQ ID NO: 1965 - DNA, 10417 bp, Homo sapiens
aaagttttgaagaagaccttaaaacctacaaagctattgaaaaggtaagatcaacatattaacatgtgccggcagattgggaaaaaaaattaatgtggcttctttgttattctttgtatccataggaacagataatgagttttatctacaggcaataatctcaaaagaggtgtactctgtgtacattgtaaggaagttgagaatgatcacaaagacccggcagtgttatacaaagtgtttgaaagggcacaataagataacagtgaaaatgatcatcacatatgttatttgggatgaacgtctgggaaattgcattgcaaatatggacagtaactgttgactgcttaagttattgagtgattggaaaatgatgacatggtagttacattcagaaagactaacagtcgtgtgtgtgtgtgtgtgtgtgtgtgtgtgtgtctgtgtaggcacggtacagtatagactttgtaccatatggtaagggtctccatacgattggaactgggagggattcattggaagaaggtgtctgcagcaggttactttggagtactgaagtatgtttaggagagagagagatattttcaggagagttttttctgtaggtacagaggcagacagcatacagcagagaggatgtgttttcatcataagttctgttttttaaatgttcagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaataggtatggcatcatatcatttgtgtggaaaacctgggaatgttgcacagtttaagtctaaacctgtacattttgtattgttgacattttgcggttaccagtctttacttagacttgccatattttcgataaagaaaagttacttcttttttcatttttttttaaatcaaaaggcaaaaacagtatcgtgcagcaataaaagttcagtattccttggcaaggctaacataatgaaggcattttaaattaggtttaatttaattttataattctcaccaatttttttctaaatcctgaaattttttgttttgtgccataaccattgggtaatgttgaattttcccctagcaataaagtaagattgtgataaactaatttatgtttttgggtacattgtaatttactttgtccagagctgataataaaatttctaagagctaagaacagcaaatgcattcctggattatataccaggataatttctattcagagacaaaagagcaagtataagattttctttgtaaccttttattttgaaacaatttcaaactttaaagtgttgtaagaatactagaattccgcatatgcctttcacccagacaccaagagagactcattcagtttcatgagaatgttctttgtagccaaagtatctaccttagagtcaggagttgtcctcaactcctgttgtcacatcttcctagtctccttcaatctggaaccattctttagtctctccttgactttaatgaccttgaaactttggaagatagataggctgtcattttgtagtcttactgtcagtctgggtttgtctgctattttcttatgatgagacccaggttacaaatttttgggcagcacatcactgagacgatggtgtcctctcctcatcctagcttaccaagtcgcacaccatgttgatttgtgcccttaccggtggtaacttagatcacttgagtgaagtctgccagttttctctactgtaaagttccctttcaccccttttataattagtagatatttcatggggagatactttgagacggtataaaatttgttccttttcccagtttgactcattagtgtaagcattctttgatatttctggcccaaattgattattactatgatggctactaaatgattttctaactccattatttctgtatttattagttggcattctaccatccatttcttctctccgtttattcattcttatattatcattttttaatgtcagtgtgaacttatggactcctgttttatttaatgggttataatctatcattatcatttactgtttgttttgatgttaaaattgtttcatatttggccagtgggaaccccttaaagctggtttctttgtctttttaacatctcactattattccttgaatacttccttgttttatggcgcaagacattctagactgccccagccttgatgttggcaatttcctcgaatttagtggagaaaaagttgtagttagaaaccaagaactggatactaggtttattcattgctaccggtgtgttgctgctgccaggcgttttagtggacagagctagaatgtttgtttgttcatgtttacatctgtatttgtttcagtgtctatctgttgatatctctattttcagtgtgacactagaggtttcattctagatttcctcctttctgtctttgtacctcctttctctaataatcagaaatttggctcccattgtcctcaaaataattagtgttcagtcttcctgtatgtagccagtctccctgctctgtagggctgcaactgtggtcaggtgcccttgctgcacaggtcgcaacctcacagggctgctgcccattccagcaccctcctgatgtgggtcctgtcccagcatccctttctgggctagctttctgccctgttccaaccttccctggtgctgttgctcagtgagttgctagttctactgtcctttttgtgtcagcactgggctgtcccgccctctgctgatgccttccttatatgtgtgctggtagttggtgggaaatgtaagatgattaaggaaaaaacattggcagtatgttttcttactggattctgaacaatactttgtgctctattatggtaacactcgacacatgttactatttaaattcaaaattcaatttaaaataaaataaaaaatggagtttcgtagttgtacttctcacatttcaagtgctcaccagccactgccctgttgggcatcgaagatatagaacatctttgcagaagttctgttagacaacactattctgtcttattcgaagtttgaagcagtaaagtttaaatgccacatataaatacaaattcagtagaggggaagaggcacatgacaaatcaaactcgaggttataaatatcaatattttctcagttgtagattcagcctcagaatttctttttcttcacagatactgtgctagattaccaagtgatccgtttactcatctagctcctaaatgcagaacccgagagttgcctgatggtacattttattcaactctttatctgccaattaactcacctcttcgagcctccattgttgtaagtttagaagaagaaatgattgttatcttttaaaatgtgtcattagtggattttttcagcttttctaagacttgcaagttataggtaaatttgattttaaaatctactttcatgagcaggagccttgtgttgacagaccaaaaataaaaataaaaaccaaatttactttcaaaagtagatttatagattgcttttgtagtcatctacatgttcatatttgtaatagactgtctaatttacagatacttagaactggactaggtgatctctgaagtttcttctaaggtgttactaacatgcacatttttgacagaatcattcaactgtggcttagacacttagagtaatataaaacttattatagatcgttgcgttgtcctagttattttgttggtgactcaaaaatctgctttttgtaaatactgttcttggtctcagtactgatttccaagtgttccaaggtgactaatttctattgcacataaaaagctgctcaatactgttaatgttatagctatgttttgataaatctttctttttgttacatatttattgattagtaaaaataagatactttaaaatcttactgaaatttaaattcatcaaaattgtaaaatcttaattatgacttagtttttactaggcaggacttttaaagatgaatatttcaaatatggagattagaatttttaaaaacttgctggaatttttcaaaataaagaattttgttttggtaaattgaactttaaaaatgttggggcagtggtttcataggtgtttcatgtgctagaggtaatacagcgatgtgcatatataatggaaaggtttttgttattttcagggtccaccaatgagctgtgtacgattggctgaaagagttgtagctctcatttgctgtgagaaactgcacaaaattggtaaggatgtttgaaaagcatatacgaatgaaaataaattgcaaccattgtaaaaaaaaagcatatagaggactttatagatctgtaaggattttgtagagctattcacttgctgatcttaatgtgctttggtgaatataaacataagtgttagtaacttgaagatcctacattgttgtgggagctctttgttttccatagcttgactgcaaacaactgtcatttatttgctctctttaatgactccttttaagtacataaaggtcttttcgtaattgttgaatcatgcaccatgaacacttgtgttttaatatgtcagtctctcaaattagtctatactagtatagaaattaatccttttttaaaaaatgaactcagtttcttttttttttttttctcaatcctgctcctgtataagtggacccattttctatggccattttatttagcattgatatgtggtgatgtcatgtttagatgtttttgtttctgaaccttagaacagaatttgcagtccagctcatattggaatatatggatgccaaaatagactttgcctgaagtgtgaatctgattacttttaaattgtaaaaggcaaaggtgctttagtttccattacttttccaggtccttctaacatagttctgttctaaattctttactaattaatcaggcaaaatctggattgtgttaattctctctttaaatttgttaggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcagttagtattggttagaacagagtaaaaacctagcatttctgactttgttttccgctacatcaaatctcagttcctctgcttggctggcttcccacacccttacagtttggcccactctggatctcagctcctttctccgattcacagcttctctcagatcagcctctttccttcctaatgtagaatgtgtgctcttccacttcagaggttgcttttgtttttcttctcaaaaggattcttggacccatctgtcatattctatccagaatgagattatttcatttaaatagacattctttgtttcattcagtttagtggtgtgattcttgttttacttatgatttggggctaagacagaagaggatttgtgtgataaaataagcaagtgaaaagatgccctctcaagatgacaggtacactggaaggtagaagcacaaatatctgtcaggagttatgtcagattcccagtgtgggccattgggaatcgaaataagttatttccatggagtgtttccagctcaatctgtgggcatcctagcagagttcacacatgaaagcatctctaaatctaacttctagtaatagacaaacttggctgaagtatttatttttaaaatatttgttaatatttttacctcataagaaccccaagcaaaagcagaattttgctgtgtgtagtagtcccgcttacccttggagggtatgttccaagacccacagtggaaactgcagatagtaccgatcctccagcagctcaacgttgtttcattagaacgttgacaaggaaaaaaaaaatcgttcccagccagggccactgtctctatgtggggttggcacattctcctcatgtctgcttactccggtttcctactacatcccaaaactgtgcacatcaggtgaactggcgtgtctgcactgccccactgtgagtgagcatggggatgcatgtgcgtgtgccctgccacagagtggtgtcctgtccgggatgggttcctgcatggggccctgagctgccaggatagactctggcacccttggccctgaactggaataagtgggtgaataatcatcttccttgtttttattcatctttcttaagtgtatctatagctcacatttattttaatgcttaatattaaaagtgtttttttttaatttagaaatttggtgatgtttttgtgatcagaaatgtgctggaggaatttaactgatttatgtcaattagcctgtgggaaaattggtttctttctaccaattggttgtttcccttagccagtttctaagaacctgccgaagacattaagtgaggacttacagcatatattatgctttttaaaatacgtttgtacatatttatgatagtttaagatataaattaggcacagtaataacaaaatagaacaattgtaaccatatactgtaataaaagttatgtgaatgtggtctctctcaaaatactgtactgtacacacctgttattggaccgtgactgacctcaggttactgaaaccatggaggctgcagataagcggggactgctgtgcctgtatgttagcctaaatatgtgtttctttggttttgcttatgcagttttaccaagtttttactttataaaattttgcacccagcttagcattttcaagattcagaatcatgtttttaaaaaatcatgaatgttacccattttcccaaaatgcatgttttcctcataccaaattttcacgtgagactagtttcatgtgataaagtcgttaatgataagtgtttctaaaagcatagtattggctgggtgtggtggttcacacctgtgatcccagcattttaggaggctgaggcaggaggatcacttgaggccaggaatccgagaccagcctggtcaacatagtgagaccttgtctctacaaaaaaagaaaagcatagtactgcctggcatcctgtttaattaatagatacattctttattttctgattctctattaaatataactgtctcttttaccagcatttttgtaccttttaactacagatgcagttctttttcattgaacctcaggaactgcaagaccataatctgaaggattgtgttaatattgaaagcctagcagcaatgtccatttaattatggttcactcacataatgaggtagccattacaaatgatgatattggctcatattgactcggacagatattctctttacagtaacgggataaaaatcaggctatctcacaaacacagatacacacataccctaatatacaccagtgttgtgtgattttatttgtattgaaaaatataaatgtatatatgtttctatgtatttatgcatagaaaaagagtctaggaattatacagtgtatcaaaatgttaataaaggctgtctttgagtgataggattatatgtgattttttaaaaatttgcctaacttcattttctgatactctacagttaatacataaaaagcccaaggaagagatgagttttcttgtcagaagaaatagatcaaatgaatagtatttttaaaaaggccctacagtgttggattgttttatgtataattttggtattagctatgtagtcagcactgcattataatgtatgtgaacttgggccaccgtcagcagccctgtcctgagatccgctgacttacccagcagggttaagtaattaagaagtgtcatgcctcgggtattttcttagcttattctcatcagcttttagtaaagccagaattaatttgttttcttgctgacatctggaaaagaggctaatatgcttgagcatgacgcttaattttcctttccaactctagattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcaggtaggtatttcataatgagtacttatgtcaaaaacgtcttgcttaggaaaaggaaaaaaaaaaaaactagtagtaagtaccttttgttacctcagtatgtttaatatttaaagatcgaggtgcctcttctatttctccactagaaagcatcatttctgttctgaagttaactgtaatggaataaaatacctgttaattttgaggggtgctttacatttccttttgctaagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttggtaagaaaaaaatctcttactttgataactctagacacatatacaaacatacagctttggtatgaaacttatctgtatcatgttttaacaagctaaagagtcgtttttctcttctaagttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaaggtaggtatttaaatggaaaggaaaatggtggtgatactttgttttaaaagatgcactaggtcgggcacggtggctcacgcctgcagtcccagcactttgggaggccaaggcgggcagatcatgaggtcaggagattgagaccatcctggccagcatggtgaaacctcgtctctactaaaaatacaaaaaattagccaggcgtggtggtgcacgcctgtagtcccagttactcgggaggctgaggcagggcaatcacttcaagctaggaggcggagattgcagtgagctgagatcgctccactgcactccagcctggagacacaccaagactctgtctcaaaaaaaaaaaaaaaattcacttattcacatgggaatataagtgggctgtgattttagcattgtaattactaataggaaatatattagtcagtcaggcatggtgatgcgtgctgtaatcacagctactcagggctgaggtgggaagattgcttcagcccaggatttctaggctgtgcagtaagctgtgatcacaccactacactccagcctgggcaacagatcggggaaaagaaagaaactcttaaggtcgacccgttctctccagtatacttgcttaaaaaataatacctaaaacgttatagataaggaattttcctttgtaaagggtcagataatctaatgttgataggctttcttcttaaaatctccatccttttagtctccagagtcttatagaatttgattataaataatgatttcatttcttaaaatttttataaggaatattaagctctgtgaaaatagtaaatccagaatgatttttttccttattttataaaaatttagggaatggagttttggggcaatacaatacaggcagttttcaaataattataatactagttgtaattcaatctttgattttttttttctttttgcacctcaaaaccatattttaaatgttagttatcaggaccatcactatcatagatgatgcagtaatacgttttatatgacaagtgtctttaatgtttagcattagtaatatacaaagtatttactctttggatagtgtaaattttttatactatttatatagatgaaatagatatgtaaaggtgccatttagcttcatgtgttatcaaaatgtagatatttagaacaagaataataataaaatgggacaataatgtgtccatttttacttgataaaaatacagttcttacatacttgaaatatatttggaatacagatgtttattgttacttatttttaatcttttgaattcttaatcatcatttccatactacaaacagttgtattttgagaatagttgatttaaatcaaaaagcaactgattgtttttttgtttttcttttttagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatct

SEQ ID NO: 1966 - DNA, 2471 bp, Homo sapiens
gtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtagaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaag

SEQ ID NO: 1967 - DNA, 2471 bp, Homo sapiens
gtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtggaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaag

SEQ ID NO: 1968 - DNA, 467 bp, Homo sapiens
attggaagctaaaagttataaagtaaaatacccaaagatttaattaaatcagtaagcatttgttgcatttttaaccagaattctttaatcatttcctgacagaatgactgtgtattagatctctgcctcattgaaattgtctaggccccctgcatctgttttgagcaagacttcagttgagttccatcttttcattcttttacagtctgtaaaggcctggtgagtcagcgcattgaaaatcagtcatcatcttctgtctatgagttcttagtggcccgtacattattttctcagatccctgcatcattacaatttccatgtgtttaagtctcttctttatgttttttaaaaaaacaagtgaagccagtttctcaaacaggaggtgctcacattctatttattctccaagtgtggagtttgtgcccagcatgtgaccgacaatacagaatgaaaagcacatgacaagc

SEQ ID NO: 1969 - DNA, 467 bp, Homo sapiens; identical to SEQ ID NO: 1968

SEQ ID NO: 1970 - DNA, 25426 bp, Homo sapiens
  misc_feature (8427)..(8427): n equals a,t,g, or c
  misc_feature (22142)..(22142): n equals a,t,g, or c
aagaatacaaagttccagatggaatggttggattcagtaagtaacttgatttttaaagttttgaaaacatgatcaaaacatactttagaatctttcaaccaaaaaaaaaatttttttttttctaactagtaattggcagaggaggtgaacagatctcacgcatacaacaggaatctggatgcaaaatacagatagctcctggtaatgttacattctcatggtattttcagtgtgactagaaaactagcttttttttttttttaagccttctagtaacaataatgctacttttaatcttttgacctgaagttatctgtttgttttaaattgtagacagtggtggccttccagaaaggtcctgtatgttaactggaacacctgaatctgtccagtaagtttgaaaaatcttaaaaatctacttaagtaacaacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttccactcctctcccaggctctttaatactgtatttccccacctccaaatcttcagcatctaaccccacgctctcccacttaagcttatttactgagaaaatggaagcaaatgataagaagcttttctttttccctaccactaaacctaccagccttcatttttcctctgttcacatagtactcaggtaattgctttccttttgtgttcgagtgcctaaagccagccctttcttcctactgaaggttcagcttgcagttgtactttcttctgcattgttagttctccctcattactaggttttttcttttcttttttttgagacgaagtctcgctctgttgccaggctggagtgcaggggcacgatctcggctcactgcaacctccgcctcccgagtagctgggactaccggtgcatgccaccacacccagctaatttttgtatttttttagtagagacagggtttcaccatgttggccgggatggtctcaatctcttgacctcgtgatccacccacctcggcctcccaaagtcctgggattacaggcgtgagccacttcccccagcctgattttctttatggcactttccaaataatgtgttattcatttgacatgttatttttacttatttaatgaaatgaagccactctagcaggaaccctgtttctttgagtgctattaccccattacctagaatagcacctgcacatagttgatatttaaatatttgttgaatgaataattgtagcatatgagtaagcaaaatggtagtttaaaaatgtaaataaatcatttagttcttggaagaatcagtttaattctgagataactttagcattagagttctttcttggaaattttggactattcttaaaaataaaaattgtatatctagaaaatttttttgcataatctctcaatctttgacccttgatggcattttctttcagttaaaagtaaaagcattgttaaagttagcatcaaggcacctaatcctgaactgggataggaggagtacttggttatattgttttatatttctctatttgaataagcttgggtatgctacagcttactatttaaatattaatttgttaacaggtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttcttttgttaatatatattatttctatgattgtaacaggaacgggctggagttaaaatggttatgattcaagacgggccgcagaacactggtgctgacaaacctcttaggattacaggagacccatataaagttcaagtaaacttaactttatactttataaagaaagagtgggttgaatggggttgggcaaaatatgcatgaataattaaaatgttttgagacatgctttctaaattagctaactttttctgctttagcaagccaaggaaatggtgttagagttaattcgtgatcaaggcggtttcagagaagttcggaatgagtatgggtcaagaataggaggaaatgaagggatagatgtaagtaaaaatacccattcagaaatggttgtatgctaattcataaatataatagtgttttctgttttgtgttaagtagctctaacattgttatccttttatttcacctttatactttagaatacagaattctatatatcttgttaccctatttactataaatatagaattatatgtacttttatgatttgaggcagattttcaggaaatggcgcttttttaaaatacttttttttactttaaaccctgagaagctagctttcttaatacttagtcttttttacataaggtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttttgaagatgatgggacaacacccgaaaggatagcacaaataacaggacctccagaccgatgtcaacatgctgcagaaattattacagaccttcttcgaagtgttcaggtttgatagaaagttaacattttcattttttgtttttatggaaaagtattttccttcatgaaatctgaagttacctctatatcagagtctgcttgatgatgctttattaatggagaaagtttaaattgctttaaggtaaagatcttggagcaggaagaactactaccttaagtgctaccttatttactcttgtagttttaaaaaatgttattactttattagggcccagttcatctctacatttcctgatcaggtatatgagagctgggaaaaataaacttaataattttatcatgaaacaaaagtatttctgtgctgactcttcgttcttgtctttccctctctataggctggtaatcctggtggacctggacctggtggtcgaggaagaggtagaggtcaaggcaactggaacatgggaccacctggtggactacaggaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatattaaatgaaaaatcttaatacaatattgtcaattaggatactgaccaaaccatatttttaatggcccatttaattgtgaccattttcttctaaatagctcctagtacacccttgaaacctttagagaaattactgtcttttgattttaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagataagaggagggtagtgttacctgtaggcatgatattagtgttggtgtaggattgtggaacatacttgaaggacatagttaacgggaattcattatttattaagattttactctactgaaccccagcgaggcaaacaagataaatcagatacatctgccactctacagtagaaattcataaatcctaggttttggactggctcacagatcatctgggggtattaaaatgtagactatttgggtgcttcccactcctacacataatatacagagacagacctgactcaaaatgtctgggatagggcccagcatctaattttacatagatgtttgggtgattctggtgcacagacaaatttggaaatttttcctccaggaaagttttctgttagaacaaaaaagtatgaaacgctttgactgcttttttgtaagtgaggcagacagtgtcttactggagtttttaacacaaagtgtgcagggggcatcttaaattattagaattgcctaggaaaaattatttttggtgtttgccatgctgtgaatggggtgcgtgcaaaacaaggttgacactgtttctgtcacacttgggaagaacacaaatagatgtacaaaagacgcttaaggaacgtcttactaaatgtacacaaacattgtgagttctgttgtatggatagtttaatggttcaaaaaatgaagaggatgtttgtagagtaatgatagaggttgatgccatggcaaaaaaatgaatagcactcatcttggttttttattttacagtattagcctaacatgcatgcgtcaggatttctgttggattcatggaaaaacaagatagattgttttggagaagcaatttggtgtggtgattaagagcatggactctgtagtcgggttgcctcagttcagaattctgtgaatcatttactggttctgtgaccttggagaagttactcaggcttttctgtgccttggtttcctcctgtaaaatgaagataatggtatctacttcatagagttgtagggattaaatgaatgttcatgtgtgtgtcacttaaaagaatgcctgccacataaccctaaaaaatgttgctactttttcagtattatttttactacttggaaagaataggtcatggatagtaagtgagagatgacagcaattggagatttaaagagacaagttaatagaagaactttaaaggtcatgaagtttagtttccctattttgcagtgagaaattgacgaccaaatgtagtgttagcattttgtccaacatgtcgcctggttgtgttaactactcagaaggagcattttaggacagttaagtgtaatgtctttgttggcttaaccaaacagaaatcagttaagcgttattaatgatgtggcatgcatgcatgataaggatataaaatatcctgatttattgaaggaattaaaaagggaatttttgtgctattaaacatcatgatacatgaaaggccaaaaaggatataaattattgatctgaatgggattttagtgacagaaataggttgtgaggtggattttagtttcatagtgaaacaactagctattaacgttatcagtgaaatgttcagaagacgatgatacaggacccaagcggtttgggaatatattgtcaagacggttgtctcatgttaggcaagtagatatagagagaagagctgaagataaggacctgatttctgtgagtaagatggaaaaagatagtaaaagtaagaatgataaaaggaaagggaactactgctgtccgcaaacaagctaaaggaaatttaattgctaatttaaatttaatttaatttaaattgcatttaattgctactgctattgattttagtgaattttacatgtctcattattatggcagatgaaatagtttttgcaaaatgaatgaggaaaggaaggaaaacctaaaatttgttatttgtgactataagagggtagaaatggatgattatttggccgtagagttgtttaaccattactgtgtttttctgatttttctatgtcatccttttttttgtagggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcagtaagtattgggtttagttctgggctttccccaaagattctagttttgggactgttttttatgctgatttttcttttcagtggtcctccagccccatatgctccccagggatggggaaatgcatatccacactggcagcagcaggctcctcctgatccaggtagaagatgcttattatttgtgtgttatctgtattattttccactcctgttacattattaaattttctagtgttgattctacatttgtatgcatcaccttcactcactttactctttcaacagtgttaggcactgcctctaccccagtgtataggactgacatgaatatgagctctgcttttatggaatttctttctacttgcctttggcttatgagttgatacagtagaatgataaaagctaaaagctgcaggaaagagcacagtgtcataggttttggataccagtgctgtcaaatgtgtagtatgttcattgtgacattatctgtggaaaaatagtttttacttatttagaaaagtatgtgataggggctgggcactgaggctcacgtctgtaatcccacctattcagaagtctgaggctgaggcttgagaccagcctgggcaatatggcaagacccatctctaaaaaaatttgttttaaattagccgggcagggtggtatgtgcctgtacttgaggctgaggtgggaggattgcttgagcctagaagttctagattgtattgagctgtgggcacaccattgcactcccctgggcaacagaatgggatcccatctcttaaaaaattatgtatatatgtaacagtctatataaatatatatatataacagtccaacagagtgttaagtattggggcattaaacttccaaattgtcaaataagatatctgttctagtactcctcatatgacaacttcatgtgagtaaaaatcaggcctgtatttaataactgcatgctaaagcccaaatacgtttaattattttctatattcagatttatttttatcctattatattctggcatctttccataccctgtagtttgctttccatcttggtcaaagagtcattctttgaaaccaattaacatttatttatgatccttttttctcacctgctacctaccttttaggcctctttcactcgtgtagtttcaaggaaaatatactcaattatggaatactttctacacataatacatttatcccaaaaaaacttgaagtaatttatgtaaatgaaattgcttgattaacttcataggaagtgtgctgtttggaatatgatgacacagcatgacagttaccaagcatgacttgagttgtgctaggatataggtgtgcaaagttggggttgtgttctatagcaaaagaatgcactcccagcgtaagcaacactgatggaaggggctcacagggtacaggatataatactcttaacaactaatttttggagaatgaaagggcttttctttccctcttgttggctgattgggatggtataattaatgggattgaagagtttgagtaggttaaaaggcagattcatattgggtaacttggatctgcccaagattgtatttttgaaccactactggggtgttagcatgattgaggaaaaatgatgggaataagaagtggaagtggtctttggtattcacaagttgaattcctccacttggagntagtagtgaaatccattactgtaagagctggtcagtgaaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactccttgagaattgctccactgccctccagcctgggcaacagagtgagacacttcatctcaaaaaaaaaaaaaaaatacagataatgacactattgagatatgtaaacatccaacataaaaaagcagtacattgggcaattgagaaaagtttggcaggtgtcctaataacaccttacaattatattaccttgcaattttctttttctagaaattcttgctcatttttctcaaacttgactaacctttattaagcagctgagaattgctactgttcagaatgaaggtataatagaaaatttaaaagttttaattgtatggtattcctagtataaaagacaatcaagttttttctggtttctagaagattgaaaggtctcaaactgttcgcacttcagttgatgtgggagatgagtgagggtcagtcaagtgtagaggagacaacatagctaaaagccgagacacgggcatagtgatttctgaaaagtacaagcactgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaataaggacaaagttcattgttctaaaataattttctttcttatacaggttagtccctagaaatgtttttctttagtcatcttctagatagagctgtttgtgcttgaggcgaaaccaatttagaaaaaaacaagggcacaggatggtttgagacagagcattggatttggagccaaaagacctgtattcatatcccagttatgccactcagtagtttttaacctaggaaagtcacttagtctctgagacttggttttctttaataaaagctgatggtgacaacaaaaataatagaaaatttaagttttcatatactttttttaatgttctagttaattttgggggctgtatatttgccagagagctgggcgggggggtggtgtgtgtgtgtgtgagagagaattacagacttcacatgcaaaccttgaactttcatttattttagctaaggcaggaacggatccaaattcagcagcttgggctgcttattacgctcactattatcaacagcaagcacagccaccaccagcagcccctgcaggtgcaccaactacaactcaaactaatggacaaggtaactacagaacttattgtatgtgaaagccaaaagttgtgcttggaattatatatgaagtacatcactgtataatacctaaaatttctgacattatttaattataatttaagcagacttttccttttttaaattgttactttgaaatagtttcaaactttcataaaagttgtaagaagaatacccggagcacccagatagcccagctgttaatgttttattcccttgtttactctgttaccatctatatcatacatgtgtatctgtatttattttaaatatccattataattagttctgaaggaagctaattatatccagcataattagttctgaaagaaatcactgaagactaaactgtagacatgatgtcctgttgggtacttcttcaaaaatacataaccatcatacagccctccaaatcagtaagtcaacattgatatattaagttctttatatcattatggatttctgatttttgcagtaggttatatttttaaagtatttttataattttgataatcagattatcctggatttggccagtcagggagtatattcagggtggtgcctatatccttttgaaatacctgtcattcttttaagcacttccatactgtctggcacagtaagattgttattttgtgctttctgggctccagccctcgagtcagctatttcttcaaggagctcttattccttttagtagagtatggtagttagaaacgagacttgagtatgcttgttgctactgaggtgtaattgcttctagcttctttcaacaggcagaactaggaaatatatttacatacatgcatacctacatacacacaccaaaaaacacataaacatcgatatatgtatatatttttaaaaactatgttcatatcaccacatccgtttcagcattttggggttttcaagccttttccttttttgtacttgtttacaaacgtgagaaacctggtgtcctcagtgtatttccttatttgacatgcatttacttatatgttcaacataaccagtcttcaaacaggttggttttcttttctgtccaccacctctgtacccccagtaccttctatctttggcactgttagggatgccaccaccacatagtacttccctcctaccctcactgtcacattgcaggcccctgccagctcctgcacccaaggaaacggccaaaattgccttttaaaaactttaattctgttttttgttttgttttgcttgaacaaggagatcagcagaatccagccccagctggacaggttgattataccaaggcttgggaagagtactacaagaaaatgggtatgttttatacatttcttgaaaatacatacttaattaaattgaaacaaattattctcttcaggaagagaataattgaataaaatcactggacttgtaaacatatcaagacagttgtaaattatagtttttaaatttgtggttatatggcaaggaaatttttttttctaattgcatttgtcaaccagttattaattgaaactagaaatgtccttactggtacatacaatattaacattactatacttttgacaatgacagttatatatattatcagtctaaatgacataaggttaaattttaatgtgtcaggcgaaaattgtgtgtgataccattatttttgctgcaagataagcaggtaagaagtaatctgcagtgacggaaagtaaccaagtgatggaaccagaatctggcttcaagagggtctgagtcccaagcttgtctcccaaatttgtctctttaggaaccatttggaacctgatactatacttctggacaaatcactatatttcagctgcttttgctcttagtcatttaaaattattacataccacagctagatgtcacaaatgaaagctaaattggtaagcttggttatccttcactagcagaaaaagaacctataggtggtagagttttgtcataagagaacggtctacttgggattttcaatgttttctttgccaaagaatgtttctcattctccacagaaagaaaaatttccagaaaggtgatgattttaatcttctagatgtaaaattacatatacctgatgataaagttgttttgcacaactggtttctttttaaagaaaaattgtttttcctcttagaatggcttcctaggagagtcatgttccgtctctttctgaggctttaacagattatgtttttgtgacctagcttaggcagatctacagtagctacaattcggcaaaaagaaacttttaacttaaaaacagcatactctgattaaggttggttacataatttattttctgaactgggatcctttttagaatgaatagggatgctattaataatcatgccctgacagcattgtggtcaggacctgtaatcaacttaactttaattaaatagcatcaccattttaaaagacttgagcatgagccacgtgcggtggcacacacttgtagtcccagctgcttgggaggctaaggtggaaggattccttgaacacaggagattgaggccagccttggcatcatagtgagacctggtcacgtgtttgggttaaaaatcactaacttcaacttctattttctcaatgggtaatgtcccctagatagggtccctagttattattaagtaggtaaaaataaaggcttgttaatggatttaggtaattatggaggaatgagtttggcttctgtgctttattttaccatattgattatttgtaatatggccattaatacatttactgtttagtcttttttgtattactttttatgttttactcaaaatgagtgggtgggtggaattctaatttttattgttaagggaagacattttaccttgtctttaattttttatttttttttaccatttccctgccagttagagatactatactatactgtcttgaatcctctgtaggaaaacatggcatagaaataattaaataataattagatgttaaataataatgctgtatgactaaagaacctccttaccccaccttttctgttgttgttctgtagtaccacaataatcacttgttaattttatttatttatttatttgagagggagtctcactctcgcccaggctggagtgcggtggcgcaatctcagctcactgcaacctccgcctcccaggttcaagcgattctccggcctcatactcccaagtagctgggattacaggcgcctgctaccacatccggctgattttttgtatatttagtagatacgggctttcatcatgttggccaagctggtctcaaactcctgacctcaggtgatccacctgcctcagccttccaaagtgttgggattatgggtgtgagccactgcacccagcctcacctgttaattttatgagcaaaacagattagttgggcaagtccttcacatgcatatctcgttgttgttgttttttttaagacggagtcttggtcttactccccaagcaatggtgcgatttcgtctcagtgcaacctctgcttcctgggttcaagctattctcctgcctcaacttcccaagtagctgggattacaggcgcccaaccacacccagctaatttttgtatttttagtagagacagagtttcaccatgttggccaggctggtctcgaactcctgacctcaggtgatccacccgcctcagcctcgcaaagtgttgggattacaggtgtgagccactgcgcctggccacatgtgtatatcttaaaggaaataatgctaggtaatttagtcaggtgcttgatgagcatttgtcatcatcatacggagtcaatttgtctttttctataaaagttctttttgtaaatgattagttgcttaactgctttaatttcttctaggtaccttacctgtcatcaggatctttttaccacaaataagaaaccttaaagcataaaacttggttcagtcttcacatttcttaaatggaaggagaaagggaataatagggagatatctttatctcaaagccaactgttgttgacttttccagtggcaggggtatgatgctaggacttcagatttcctgattccccatcctagtgccccttttgccaaactaggcaggctttcacagcttttggagcctaatttaagtttttcttgttaagaacagaaaactccattcatagattttaatttgtcattatttgcttatttactgaaaaaaaaaaaaaactattgaaaacaggtgtgggttaagtttcccaaaattaggtttatatttcaaaacaattctaagttcccaaggataacaccaaactaagaggataaatttttattttatttttttttattttatttttttgagatggagcctttccctgtcgcccaggctgaagtgcagtggcatgatctcggctcacttgcagcatccacctcccaggttgaagcaattcttctgcctcagcctcccaagtagagaaaatcttgataagatttcagaggcttataaggaacagcagtaaagatgggtgtttttaaagctagaatacagggatttttttaagacccttaagagaacaaacagggtttcaaaatagaaaggagtaattcttgtttggagaagtgaagacatttgggaaaagtttgacttgaggaaggccattatgataaggactgatgtggtagactctgaaccctgaagaatctggtaccttaagcctaaaggagggtagagtgaggacttgtgggaaaggtacagttatatgggaagacaactgagtgtgaaaatctattcatgcaaggctggctcttaggctctaatagaatcttgcaagctaactctagagcaagtcttttatctttgggatgaaagaaatttaaggctaaactttatacattataattataaaactataataaatattagataatgttctactgaagtataaactcaactatctggcatcaaacagtaactaagccatgatcacaccactgccactgtgttctggcctagtgtgacagagcaagaccctgtctcaaaacaaaatccagtaactaaagagaggaataaggggagcgcaaggtaaggcagtacatgtctgaaggggcagggaaagagttctttctctacttccaactgggcaaaataaatcacatttgccctttagattggaagagtgaaataagcttttcttgaacatcttttaagattggagtgtcaaatattaccaacttatttaccaagaatttggtttttcttaaagtctaaagtgtttactattagctttccacagggatataggagtttgcagaggttgtagttttttaagggaacatcaatgaattttcttgatgcatatgcctgtttctaccattttacattgttaatttgcctctaaaatgagtaactcttacaatggggtttaaaacctgaagactattgattgctaccttgatcaggtttggtttcaagtgtgcaccctgtaagagacaatgtgtggttttattgctattgtcacaccagttttttagatattgaaacctgtttcagatttgcttgaattgtgtcttgtaagaggaaaatgttaaacttacttcctctttgagaacagttatttatagaagacaggaaaatatgagaatttttaatagtatatgagagttctctgttaccaagaaaagagggtttttttcaggcatttttaaagaatcataaatcttaaattctttcactcagttgctttgagtctgtgacctgttttacaatggtgatagactgctttctgaaactatgaaattggtcttgttggcatgctcctacaaacataaaaagagcttcctgtgtgtccatgctccagtatactcgtctatggtagttatttcacaaagccaagcgagttacaaacgaaataaaatagtgcttaagtaaagaaactgaataggagaacatatactctctcttctcaattttatatttagaaaaatataccttcagaaattggggaaataggcatcagacactcagcttcatcattttttaaaagtttgctgtatgcgctttatatgtatgttttttgtgtatgaaccatttcaaagtaagttgcagacaagacagtttgctctaaataaactcaatgtctgggcacagtggttgacgcctgtaatcccaggactttgggaggccaaggcaggtggatcacttgagtccaggagttcaggaccagcctggacaacatggcaaaaccccatctctacaaaaaaagagaaaaatgtcagctaggcatggtgggcctgtagtcccagctactctagaggctgaggtgggaggatcacctgagccctgggaggttgaggctgcagtgagccatgattgcaccgctgcactccagcctgggtggcagagtgagaccctgtctgaaaataaataccctcaatattatcacaaacatacagactatatttaaatttccatagttgtcaggaatatgtcttttgtcgtctgtgtgttttgtttaattcagagtacattcaagattcatgcgttgcatttcattgctatatttctttaatctcttaattcagcaaagtcaccttatttggaaaaagacctgattgtgaaagctgagttttatgtgttttcattgatcttgttctttattccttgtcaggttacttttaataacattgtgttgtaattggaataaattattaatacttttaacatcttattatgtgtgtgtgtacatacactttataggttactaatcaggaaaaagtcttggctaggtcttaatacagtctttaaatcattgcctttaagtgggcttaaagtttttcaaaaatgttctttttgtaattctggaatcgaattaagattatgcctaaatctttaccttccttagctaaagcagtgtggatttggggttgattctgtttttttactaataatgacgctctagaactaaaagttaacgattaattataaggcaaaaagaaaagagcgttctttttttttttctaattgcagagtagtttcctgacactactaaatgaatattttaaataaaacaggagtaattctgaccctctgtgcttttgtcttataacctgtacttacagtggatgtaattttatattaaagtttaggggtttttttttttggtcaacaagggcaaacacaagattattcaaaggcttgggagaaatattacaagaagcaaggtattgtttttattagaaatgagatgttgggcttataattgtggttacagcaacaaagttcttttttttcaaaggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgcatgaactgcaacagtatctttttgtcaatgttccacataatgcaaatgccatacgttgtgtgatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcatcagtatttttctgatttaataatatttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaattgacaatgtttntagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtattggcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattataaaggagtgctttgtgttttttatacatatattacatggtaaaattttctacttgactgggtttttttttatgtttactgtgagaaaaaatgattttaaaaagttttaatgataaaagggtaacatctggttgcacaagtcttaaaatacagaaagacttttaaatacagaagttactttatttgggttcacgttgtaaaataaaattgtcttccagaaaattaaaatataaaacaacttaatagaacgtaatagctaattatttacaaactcattttaaagactagaattttaaatcgaaggttgtgccactttttccctaagtctgatacacttagatcttgaagccttcgactatgttgaaagtgttttctcttgcgtgaactattaatagaaagttttttcattaaaatataatttgttcaggcaagatcacaacataaatttgctttataaatttaatatatattacatacgtttgaaaaataacatgtttaatatcctcaacactcaacactgtatagccattctttaagtcctttaatttttgtttttctccatgctcctccccttttcctctgaaaggagtgacagttttccccaccccgctccaatcccaatatatctgcttcagaaagactttgaaactacaacaaccaaaatggtgtactactaaagaaaaagtccactcaaattgataggttccaaattaattatctcagctatttcagcctaattttaggtgtaaaaagctcagaaatgacattccttcatgcaaaataatgtattctacttaggtttgtgtgttttttttttgtttttgttttttaaacatagttgctgtaaacgtctatgggaaatacagtctttataataggttctgatagaataattgagtaattcccccccataagtacattttattgactgttactgcataataggcgataaatctgatgcttatttggaaaagaagtaggcattctttagatgagctgtgctttgaagactgttatgaaaaggaataagaagtcagcatagtggcactcctggtttccttttttggccccgccacagaaaagatggatgtagtaagaaagttggagtgaaagagaaagttccagggagaggggaggggagctagtagtcatcagctaaaaaagagaagaagaaaagtgattttaaggaaaaaaaaattaatagaataaaagataaaaagagtgattaattcttactttcaatggtaagaatacaggtactagctgcagatcctttattgttgactgctttacacatatactctcctccatcttctgggaaagtttctggtaagtaaaggcagtaagtttctcccctttcaatatattgatagtcttctccatcctgcagtatttctccttcaaaccaccatgtaatttctggttgggttctcctgttactttaaccgtaaatctgactggctcactgtctacaactgatgtgtttttaagaggcttcttgaaccatggagctcctgatctggtttgctcttcatcttcagcagtggagccattcatgatgctaccttcttcctcctcctcctcttctcttttctgtattaaaataaatgcattcaggttggcatttatagtattttcagggcagcgatttagtaacaattttgaaatgaaatttttttttttaagtaaagaacatacaagtgtgcctactacaaagtgtacttaacagtacattccagtgacttgaaagaaaaccattaaaacatttttttaacctacctaattataaaactatgggttttaagagggcatctttggaaaataaaggatacataagcctggtaccttttgtagtgctgcatcaatttccctttgttcaaactgcatgcgtagtaacttttgttcttcaattcttctttgttcttcttcttctcttgccttagccatttgttcaaatctagctttcatattcactttgtgagtaaatggagcctcgctttttcttgcaggcctaacatcaacatcatcttcctgcaagaaagtgggccaagattaacaattgcttgccttctaaaaacaaagaagcgttactagttctaaaggtgtttagaagcacaaaatgattaacatgtttataatgcatatttttgctacactgcagacactcagattttttctaactctccagttcaggaaaagtgatagatacatttatgaagcattctcttagttatagactttttctccaaatgtaaagatcacaatatcactgggatcctagcctgtttgtcctaccaactctgcttggttttgatagcacttaactgaaaaaggtcagaatgctatacattctaaataattgttaaaagtactcccttgattcctgtaagtcc

SEQ ID NO: 1971 - DNA, 286 bp, Homo sapiens
tagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaa

SEQ ID NO: 1972 - DNA, 1800 bp, Homo sapiens
tctcaaacatgcacgtgtacctttaggatgaatttctgcaattggatgtgccaggccagagcgtgtgcatttgtggctttggttgacatcacctagtcgcccttcctggggcctgtgctggtgtactctgaggcgcgattgtgtgaaaggtgggcgaaggtgcctgttcgaccacatcctcactggtagactgggtcaccacagttttggaaaggtgagaaatggtatctaaacatagtttgaatttgcatttcttttactggaagggaggctgcgcgtgtttcacatcagagccatgtgtgtttgtggttgttgaactttctctcttggattgctaggagtgctttatgtattagggaagcagacttccctaatgcgtgataacgcatgcagatactgtttccaagtttttgttatttgtcttttaaatttgtttttgcatttgtcttttcactttgatttttgccaggctggagttttgatgtttatgtggtcataggtgtgaatattttcttttgtggcttctggattttgagacacagtggctatagaaccactgtagccaaaagttatgtttgcttttggtttcatatactttgctttggtcctgtcttcttgactttatttaaaatagtaagatattcttactacatttttccattgcccatagctggaaggagattgtaattatcaccaaagatgaaaaactaaggcatgttctcagcagaggcagattagactttaagttagaggcttgtccttggtgcagaggcctgtgagcgacccggccccacttgccctgcacaccatggcgtggattgtgggcagtcacagggaagacctctggctttgctgggagctggggtacggttcttagagtgccattctagagtggcttcgcgtactggtaatgaacgcccatcaagtggccttgggaattcatgagccggatgatgatgacttcgccggtgaaaagcaaatcccaaataggttgttttctgtgcattccagtcccaatttctcttccaagtaattattagatgtgccaagcctgttacgtttattacttacagaattgtttttgtctgtgtgagtttactgaggacttaggggttggtatgtgaggaggggagccccccttctcctgtgggcactctagcactcttaataatcagtattaaacatgttgaaggccataaaggaaataaccttctcttaaaaacaagttagagtcagtcataaaactgtttgcctagaccttgatcacttaaaataagatcttagatgtgatgtgtctttgtggagtatttcctgtggctcgggaggtgtgcatgagagtggggtctgagggacagtgaggggtgaaggaaaggtgggagagagggccttcagtgactgtaccaaagactcacagacactgggtgtcttggtgatgggtgcacatagcccttcttttgtgactgaagctgtgtggccttcatcccacagggtctgccctctccagataattctgtcactgaacttcaaactgtcaatggaacgatagcgcagtctcttaacaatgcttcaggacagataatagagctgtgcgggcagcctcggtgacagtgttgggaatctgcagaatggctttgtccacttctttcctttcagaggagacattgaacctcggcatggtgtctcacgccaggaatcccagcatgttgggaggctgaggttgggggatcggattgcttgaggctaggagcttgaggtcagcctgcgcaacatagtgagaccctgtctctaccaaaaaaaaaa

SEQ ID NO: 1973 - DNA, 1776 bp, Homo sapiens
tctcaaacatgcacgtgtacctttaggatgaatttctgcaattggatgtgccaaggccagagcgtgtgcatttgtggctttggttgacatcaccaagtcgcccttcctggggcctgtgctggtgtactctgaggcgcgattgtgtgaaaggtgggcgaaggtgcctgttcgaccacatcctcactggtagactgggtcaccacagttttggaaaggtgagaaatggtatctaaacatagtttgaatttgcatttcttttactggaagggaggctgcgcgtgtttcacatcagagccatgtgtgtttgtggttgttgaactttctctcttggattgctaggagtgctttatgtattagggaagcagacttccctaatgcgtgataacgcatgcagatactgtttccaagtttttgttatttgtcttttaaatttgtttttgcatttgtcttttcactttgatttttgccaggctggagttttgatgtttatgtggtcataggtgtgaatattttcttttgtggcttctggattttgagacacagtggctatagaaccactgtagccaaaagttatgtttgcttttggtttcatatactttgctttggtcctgtcttcttgactttatttaaaatagtaagatattcttactacatttttccattgcccatagctggaaggagattgtaattatcaccaaagatgaaaaactaaggcatgttctcagcagaggcagattagactttaagttagaggcttgtccttggtgcagaggcctgtgagcgacccggccccacttgccctgcacaccatggcgtggattgtgggcagtcacagggaagacctctggctttgctgggagctggggtacggttcttagagtgccattctagagtggcttcgcgtactggtaatgaacgcccatcaagtggccttgggaattcatgagccggatgatgatgacttcgccggtgaaaagcaaatcccaaataggttgttttctgtgcattccagtcccaatttctcttccaagtaattattagatgtgccaagcctgttacgtttattacttacagaattgtttttgtctgtgtgagtttactgaggacttaggggttggtatgtgaggaggggagccccccttctcctgtgggcactctagcactcttaataatcagtattaaacatgttgaaggccataaaggaaataaccttctcttaaaaacaagttagagtcagtcataaaactgtttgcctagaccttgatcacttaaaataagatcttagatgtgatgtgtctttgtggagtatttcctgtggctcgggaggtgtgcatgagagtggggtctgagggacagtgaggggtgaaggaaaggtgggagagagggccttcagtgactgtaccaaagactcacagacactgggtgtcttggtgatgggtgcacatagcccttcttttgtgactgaagctgtgtggccttcatcccacagggtctgccctctccagataattctgtcactgaacttcaaactgtcaatggaacgatagcgcagtctcttaacaatgcttcaggacagataatagagctgtgcgggcagcctcggtgacagtgttgggaatctgcagaatggctttgtccacttctttcctttcagaggagacattgaacctcggcatggtgtctcacgccaggaatcccagcatgttgggaggctgaggttgggggatcggattgcttgaggctaggagcttgaggtcagcctgcgcaacatagtga

SEQ ID NO: 1974 - DNA, 110 bp, Homo sapiens
cgtactcaatgtgaagataacgagaatgaagaactttatgatggttcacttccacttactgaatactaaatatattttctctttcttatgattttctttttttaattaaa

SEQ ID NO: 1975 - DNA, 110 bp, Homo sapiens; identical to SEQ ID NO: 1974

SEQ ID NO: 1976 - DNA, 148 bp, Homo sapiens
  misc_feature (136)..(136): n equals a,t,g, or c
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaa

SEQ ID NO: 1977 - DNA, 152 bp, Homo sapiens
aaaaaaataaaaaaaaaaaaaaaaaaaaaaaaaataaaacaaaaaaaaaatataaaaaaaaaaaaaaaaaaaaaaaaaaaaaaaaaaaaaaaaaaaaaaacaaaaaaaaaaaaaaaaaatataaaaaaaaaaaaaaaaaaaaaattaaagag

SEQ ID NO: 1978 - DNA, 151 bp, Homo sapiens
aaaaaaaaaaaaaaaaaaaagaaaaaaaaaaaaaaaaaaaaaaaaaaaaaaaaaaaacaaaaaaaacaaaaaaaaaaaaaaaaaaaaaaataaataaaaaaaaaagagaaaaaaataaaaataaagaaataaataaaaaaaaaaaaaaaaa

SEQ ID NO: 1979 - DNA, 202 bp, Homo sapiens
aaaaaaaagaaaaaaaaaaaaaaaaataaaaaaaaaaaaaaaaaaaaaaaaaaaaaaaaaaaaaaaaaaaaaacaaaaaataaaaaaaaaaagaaaaaaaaaaaaataaaaaaaaaaataaaaaaaaacaaaaaaacaaaaaaaaaaaaaaaaaaaaaaaaaaaaaaaaaataaacaaaaaaaaaataaaacaaaaaaaaaa

SEQ ID NO: 1980 - DNA, 158 bp, Homo sapiens
taaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaataaaaaaaaaaaaaataaaaaaaaaaaaaaaaaataaactaaaaaaaaaaaataaaaaaa

SEQ ID NO: 1981 - DNA, 126 bp, Homo sapiens
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c
gccaaaaannaaanaaaaanaaaaaaaaaaaaaaaaaaaaaaaaaaaaaaaaaaaaaaaaaaaaaaaaaaaaaaaaaaaaaaaaaaaaaaaaaanaaaaaaaaaaannanaaaaaaanaaaaaaaa

SEQ ID NO: 1982 - DNA, 77 bp, Homo sapiens
aaataaaaaaaaaaaaaaaaaaaaaaaaaaaaaaaaaaaaaaaaaaaaaaaaaaaaaaaaataaaaaaaaaaaaaaa

SEQ ID NO: 1983 - DNA, 964 bp, Homo sapiens
ctcacaagataatatctcttgcctttttcctctcggagtgttcctgcggtttgtgatctctcttagctctggtagcctgttcaggccttaaggtatctgttcggtattatgtggtcaagtagctgggaccacaggatcacaacaccacgtctggctaatttttttttttttttttttttttttttgtagagatggggtttcgctatgttggccaggctggtctcaaactcctggcctcaagcaatcttccagccttggcctcccaaagtgctgggattacaggtgtgagccaccacgtctggcttggagggcttattaaaacaccgattcttagcctcacccccagagtttctggttagtaggtcttggcagggctggagaatttgtatttccacaccttccttggtgatgtgttgttggtagttcagggagtacatgtgagaggaaccgtttagatagtaaaaactgcaaacctgaagaagaatagaagaatccttattctgtgctctcttagatttagtttcctcatctatgatcaataactattcatttcttcctcatttccaataacgatttgctgcttttaagagcaagagatcacttttccttcatgttgttttgctagtggcaaatcagaaatggtttcgccagtattcactgatcttgtaatcactctcggaatccagctgcatctctagtgtagagttttgggtcaacaagaataatgctgagcttaaagaattggactcagtctcttgaagtcaggggttgatgagaaggtggctctaatctattcattcaacaacttcctattgagcacctgctatgtgccaggtgctgttctagccactaagatagagcaggtaataacatagggccattgtccttatggaatttgtattttagtggggtgaataaaaaagggcagtctaggtggggcccagaaatagaaaaatagaaaaaa

SEQ ID NO: 1984 - DNA, 964 bp, Homo sapiens; identical to SEQ ID NO: 1983

SEQ ID NO: 1985 - DNA, 236 bp, Homo sapiens
tgggtggatcacgaggtcaggagttcaagaccagcctggccaacgtggtgaaccctcatctctaataaaaatgcaaaaattagccaagcatgatgatgcgtttctggaatcccagctactcagtgaggctgaggcaggagaatcgcttgaacctgggaaacagaggttgcagtgcactcagattgtgtcattgcactccagcctgggccacatagtgtgactctttcccccatccc

SEQ ID NO: 1986 - DNA, 236 bp, Homo sapiens; identical to SEQ ID NO: 1985

SEQ ID NO: 1987 - DNA, 3722 bp, Homo sapiens
cagatgcttcccactagagaagctaagaagctgtggcagccacagccgggacagggcctggcctccagcccagggctttccctgatgtccagcctcagctgcctcttcctgcctcatcccacccgcaagaggagctggggaccagagacagagacacaaactccatttgaatgtgaaccttggcaccatggagatgctcagggtgagcccagtctgctctctcattagtatgaatttccttgtgtttctgtctctctcctcttccctggtatcagctgctggccccaggttcctccagagaggagcgggggtgggtggggtggtgctgattaaatctgaggacatgacattgagcgagagaagcaaggggagctgctgacctccctggatggataaccatcaggaggcggtagcagagtccacataccatcaccttctcctgcagatgttggttcagccacctttcctctaccacagatgggctatgtgttttcaaagcagaagagcagagacggcagagaaccccagctggttcccaggcaaggataatgaatacagtcccctggaatgtgggggcctgccgcctggccctccccaccaccaactgccccccttcagcagactcctctgcttccccaagcaggtgggccaggctgttgtctgggaatgccacctgccaccaggcacatgagcagccaggccaggatgaggtgggcagcagaggctgctgcagcctggggcaggggtcagcacagcatctctccatccctgcctttgggcagcccatccgcccacgcgtggatccgccaaagcaaagccctgccttctctctcgcggggcgctcagagttgcacactctgggttggtctttgatgacaccggccttgtggaaggagcaaaaaaacaaacctttaatgtggacctgcaacaccttccattccacttccattatgtaatcttgggagtcactcaactctccaagcctcagtgccctcctctgtaaagtgaggccgtgaatagttccgactccacagcattgctgtgtggtgcaaataagaaaatacacttgacgcaccagcacgaggcctggcacctgcctggttcctatgatctctgtgtgccaagccctcagccaggcaaagtgtccccgggtttttctccagttctatggcattgaatcctaacaaaacccagcaagggaggtgtcacaggacttcctggtacgcgccaggagactgtggctcagaaaacaggtgttgactctgtctcgagcagtctgtaaatgtggagttggggctcacccccgcccccaactcccatcctctagcaaaaccaaggccttctgtcattgcaaatggcctgcaaacttgagagtgattggaaatgcatccccaccctccagaacccataagagacccagcgcctgagcccacacatgggagtagctcctgagtacaggcagggcaagggcgggaggcaggaaggcaggagccagatgatggattagcacaggaaggagcacagcacctggagttgctttttagtcttcttcccaagaactgcatggggctggcagggagaggaggggaagtaggaggccacacgacacctggcacccattgtatgttttttatttttttttatttttttgatggggataagatttgcatgacataaaattagccattttaagactgactcatgccttaatcctagcactttgggaggccgaggtgggtacattgcttgagtccaagagttcgagatcagcctgggcaacgtgtcaaaacctcatctctactaaaaatacaaaatattagccaagcatggtggcacgcgcctgtggtcccaggtactcgagaggctaaagtggaggatcacttgagcctgggagttcaaggctgcagtgagctatgattgcaccaccacactcccgcctgggcagcagagcgagacccggtctcaaaaaaaaaaaaaaaaaaaaaatcattttcaagtgagcaattcagtggcacttagtacattcacaatgatgtacaaccaccactgagttccagaatactttcatcaccccagaaggaagcctgtacccactcacagtcactccccattcccctctctcccaaccacctgccagtcaccaatctgagccccatctctatggatctacctactctggatatctcatataaatggcatcatacaatagttgacctcttatttagtttgatggcaagagggggaaggagctgctgctggagcccctccaggccctgcctgaagcttctgcttgtggggaagtttctagatgctcagagggagcagcccagtctgccctagacctttgtttacctccttctttggggctccgctgtgtagtggactgggtgccggtggtcctgggctttggtctcagctcagcagctgatgcagagtcctcagggaagctgctgcacctctctgggccccaggggtctcgtatgtgaagcgagcggttgaacttgtgggtccctgttgctgcttttgcacccccccactactcccaataagttctgaggagagacgggactccctgtggtagagacaaagggccactgctgattggaggggaggaggtccagaagctccttctaaaacggaaagaaagagaggggaagtggccttgaccttggtccagcaaggggcagtgggccaccagacctcgtgggttctctgccaaccatgagagccagtaaaagggataaagaaggtgaccagggcaggagcagagcccagtgtccaggggtgcacaacggcctgcttccctccagattgggtgcagccccagatgggtgacaccaggatggccgtgggccctaggagtgactggggaggaggccgcgtgtgtgtggtgtgtgctggccggcaggcatgtgcaggcttctgtgtataatctggcttgtaaattgctcggggactgtaactgcggaaagggccatagagccgcgtggtgttattatttatgataaagcacagaggtgcctgccagggactagaatgggctgagcactgcgtgcaggatggacggcaaattgaactccaattttctgctcggcagtctttgttacacgccacaaagcgctggtacaccggggtcaccagcctgatgaatgtgtgttcttcctcagcggtggctccatctctcagcctccgtgcagagagcgactcgtgctttgttttttcctccctgcggggcccagccttggaatctgttcctgggctccaaacgcagcctggacagaggggaggtcagaggccttgcatggaggcaggcggctatgggttcaaaacccagctctgccactgacacacatgtgactgggtacctctctcatctgagcttcagatgagagaaataaaagagaagtcctcatagcactcccctaaggaggctgggaggattaaatgggtaaacatgcgctgctcagtgtggagtaggcctttaacaaatacccatctttccttcttgtccctgggctgagcagcctcgccctgaagccaggaaattgaggagaagcccctgaaattgggcagacaggccccgtctgggggtggtgaggtcaagcccctaaggacacctgctgtccagctcagccctctttattcaatattgggaaaccaatgctggtgttaagtcagagccactgcccctagctcccatcttcccccagcttccatctctc

SEQ ID NO: 1988 - DNA, 278 bp, Homo sapiens
ctcgatttccaaatcaggtcacattctgaggttttgggaaggacatgaatttgggggagacatattcaacccaatacaggcatcacctagtcttgtcccacagatgactttattaaacatcccttggcttccatgttgggccttactgtcattcatttgccacatatttcccaagcatcttctttgtctcaggctctgtgcccagtgccagggctatagaaaaacaggagtcttgggcccagctctcctggcatctgtgtgatgtgttctgcttttct
